United States Patent 11,931,406 (FLAVIVIRUS VACCINE) - sequence listing, part 8

SEQ ID NO: 5577 - RNA, 9879 nt, Artificial Sequence
  derived and/or modified CDS sequence (wt) from DENV-1__FJ410174__SS-prME
ucugugaccaugcuccucaugcugcugcccacagcccuggcguuccauuugaccacacgagggggagagccacacaugauaguuaguaagcaggaaagaggaaagucacuguuguuuaagaccucugcaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacauguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgaugugugggaauaggcaacagagacuucguugaaggacugucaggagcaacguggguggacgugguauuggagcauggaagcugcgucaccaccauagcaaaagauaaaccaacauuggacauugaacucuugaagacggaggucacaaacccugccgucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacauagauacucauggaaaagcuggggaaaagccaaaaucauaggagcagacauacagaauaccaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaggcaguccaugcugacaugggguacuggauagaaagugaaaagaacgagaccuggaagcuagcgagagccuccuucauagaagucaagacauguaucuggccaaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgaggcccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuaugcguaucaauaaugauugaagaagugaugagauccagauggaguagaaagaugcugaugacuggaacauuggcuguuuuccuccuucuuauaaugggacaacugacauggaaugaccugauuagguuaugcaucaugguuggagcuaaugcuucagacaggauggggaugggaauaacguaccuggccuugauggcuacuuucaaaaugagaccaauguucgcuguugggcuacuauuucgcagacuaacauccagagaaguucuucuucucacgauuggauuaagccugguggcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaagaguuggccccucaaugaaggaauuauggcuauuggaauagucagcauucuacuaaguucacuccuuaaaaaugaugugccguuggccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaagugggagugggaguuuuccaagacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagccguugaaccaggaaaaaaucccaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggaggagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaagcaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugccucagaagguuuccaguacuccgacagaagguggugcuuugacggggaaaggaacaaccagguguuggaggagaacauggacguggagaucuggacaaaggaaggagaaagaaagaaauugcgaccccgcugguuggaugccagaacauacucugauccacuggcccuucgugaguuuaaagaguuugcagcaggaagaagaagugucucaggugaccuaauacuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggccauguagcugccgaaaaccaacaccaugccacgaugcuggacguagaccuacgcccagcuucagccuggacccucuaugcaguagccacaacaguuaucacucccaugaugagacacacaauugaaaacacaacagcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggcccugugugaauccaucacacuggcuacuggacccuugaccacucucugggagggaucuccaggaaaauucuggaauaccacgauagcaguguccauggcaaacaucuucaggggaaguuaucuagcaggagcagcucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacaaagaguguuuaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggcuaaaaucacugacaucauggaggcugaacacgcucuauuggcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuugacugguuggaaaaacauggcacugaaaggcugaaaagaauggcaauuagcggagaugauuguguggugaaaccaguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacugggucccaaccagccgcacaaccuggucaauccaugcucaccaucaauggaugacaacagaagauauguuaucaguguggaauaggguuuggauagaggaaaacccauggauggaggauaaaacucauguauccagcugggaagaagucccauacuuagggaaaagggaagaucaaugguguggaucccugauaggcuugacagcgagggccacuugggccacuaacauacaaguagccauaaaccaagugagaaggcucaucgggaaugagaauuaucuagauuacaugacaucaaugaagagauucaagaaugagagugaucccgaaggggcacucugguaa

SEQ ID NO: 5578 - RNA, 9879 nt, Artificial Sequence
  derived and/or modified CDS sequence (wt) from DENV-1__FJ410175__SS-prME
ucugugaccaugcuccucaugcugcugcccacagcccuggcguuccauuugaccacacgagggggagagccacacaugauaguuaguaagcaggaaagaggaaagucacuguuguuuaagaccucugcaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggguucacggugacagcccuuuuuuuagcacaugccauaggaacauccauuacucagaaagggaucauuuucauuuugcugaugcuaguaacaccaucaauggccaugcgaugugugggaauaggcaacagagacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuugggaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuucggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacauagauacucauggaaaagcuggggaaaagccaaaaucauaggagcagacauacagaauaccaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaggcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgaggcccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuauguguaucaauaaugauugaagaagugaugagauccagauggaguagaaagaugcugaugacuggaacauuggcuguuuuccuccuucuuauaaugggacaacugacauggaaugaccugauuagguuaugcaucaugguuggagcuaaugcuucagacaggauggggaugggaacaacguaccuggccuugauggcuacuuucaaaaugagaccaauguucgcuguugggcuacuauuucgcagacuaacauccagagaaguucuucuucucacgauuggauuaagccugguggcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuggccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaaguaggagugggaguuuuccaagacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagcuguugaaccaggaaaaaaucccaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggaggagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaagcaaugcaguuauccaagaugaggaaagagacaucccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugccucagaagguuuccaguacuccgacagaagguggugcuuugacggggaaaggaacaaccagguguuggaggagaacauggacguggagaucuggacaaaggaaggagaaaggaagaaauugcgaccccgcugguuggaugccagaacauacucugauccacuggcccuucgugaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacugccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggccauguagccgccgaaaaccaacaccaugccacgaugcuggacguagaccuacgcccagcuucagccuggacccucuaugcaguagccacaacaguuaucacucccaugaugagacacacaauugaaaacacaacggcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggcccugugugaauccaucacacuggcuacuggaccccugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagcuaugaccgauaccacacccuucggacaacagagaguguuuaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggcuagaaucacugacaucauggagccugaacacgcucuauuggcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuugacugguuggaaaaacauggcacugaaaggcugaaaagaauggcaauuagcggagaugauuguguggugaaaccaguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacugggucccaaccagccgcacaaccuggucaauccaugcucaccaucaauggaugacaacagaagauauguuaucaguguggaauaggguuuggauagaggaaaacccauggauggaggauaaaacucauguauccagcugggaagaagucccauacuuagggaaaagggaagaucaaugguguggaucccugauaggcuugacagcgagggccacuugggccacuaacauacaaguagccauaaaccaagugagaaggcucaucgggaaugagaauuaucuagauuacaugacaucaaugaagagauucaagaaugagagugaucccgaaggggcacucugguaa

SEQ ID NO: 5579 - RNA, 9879 nt, Artificial Sequence
  derived and/or modified CDS sequence (wt) from DENV-1__FJ562105__SS-prME
uccgugaccaugcuccucaugcugcugcccacaguccuggcuuuccauuugaccacacgagggggagagccacacaugauaguugguaagcaggaaagaggaaagucacucuuguucaagaccucugcaggugucaauaugugcacucucaucgcgauggauuugggagaguugugugaggacacaaugacuuacaaaugcccccggaucacugaggcggaaccagaugacguugacugcuggugcaaugccacagacacaugggugaccuaugggacguguucucaaaccggugaacaccgacgagacaaacguuccguggcacuggccccacacgugggacuuggucuagaaacaagaaccgaaacauggauguccucagaaggcgccuggaaacaaauacaaaaaguggagacuugggcuuugagacauccaggauucacggugauagcuuuuuuuuuagcacaugccauaggaacauccaucacucagaaagggaucauuuucauucugcugaugcugguaacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaauugugcauugaagcuaaaauaucaaacaccaccaccgauucaagauguccaacacaaggagaggcuacacuaguggaagaacaagacgcgaacuuugugugucgacgaacguuuguggacagaggcuggggcaauggcugcggacuauuuggaaaaggaagccuacugacgugugcuaaguucaagugugugacaaaacuggaaggaaagauaguucaauaugaaaacuuaaaauauucagugauagucacuguccacacaggggaccagcaccaggugggaaacgagacuacagaacauggaacaauugcaaccauaacaccucaagcuccuacgucggaaauacagcugaccgacuacggagcccucacacuggacugcucacccagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaaaaagcaagaaguagucguacugggaucacaggaaggagcaaugcacacugcguugaccggggcgacagaaauccagacgucaggaacgacaacaaucuuugcaggacaccugaaaugcagacuaaaaauggauaaacugacuuuaaaagggaugucauaugugaugugcacaggcucauuuaagcuagagaaggaaguggcugagacccagcaugggacuguccuagugcagguuaaauacgaaggaacagaugcgccauguaagaucccccuuucgacccaagaugagaaaggagugacccagaaugggagauugauaacagccaaucccauaguuacugacaaagaaaaaccagucaacauugagacagaaccaccuuuuggugagagcuacaucauaguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacgucugugggaaaauugguacaccagguuuuuggaaccgcauacgggguccuguucagcggcguuucuuggaccaugaaaauaggaauagggauccugcugacaugguugggauuaaauucaaggagcgcgucgcuuucgaugacgugcauugcaguuggcaugguuacacuguaccuaggagucaugguucaagcggacucgggauguguaaucaacuggaagggcagagaacucaaguguggaaguggcauuuuugucacuaaugaaguccacacuuggacagagcaauacaaauuccaggcugacuccccaaaaagacugucagcagccauugggaaggcaugggaggagggcguguguggaguucgaucagccacgcgucuugagaauaucauguggaagcaaauaucaaaugaauugaaccacauucuacucgaaaaugacaugaaauucacagugguuguaggagaugcuaauggaauuuuggcccaggggaaaaaaaugaucaggccacaacccauggaacacaaauacucauggaaaagcuggggaaaagccaagaucauaggagcagacauacagaauaccaccuucaucaucgacggcccagacacuccagaaugccccgaugaccaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaaguuagcgagagccuccuucauagaagucaagacaugcauuuggccgaaaucccacacucuauggaguaauggaguuuuggaaagugaaaugauaaucccaaagauauauggaggaccaauaucucagcacaauuacagaccaggguauuucacacaaacagcagggccauggcaccuaggcaaguuggaauuggauuuugacuugugugaaggcaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauugggaauauuaugcuuaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucugacaggauggggaugggaacaacguaccuagccuugauggcuacuuucaaaaugagaccaauguucgccguuggguuauuauuucgcagacuaacauccagagagguucuucuucucacgauuggauuaagccugguggcauccguggagcuaccaaauucuuuggaggagcuaggggauggacuugcaauggguaucaugauguuaaaacuauugacugaauuucagccacaccaguuauggaccaccuuacugucucugacauuuaucaaaacaacucuuucauuggauuaugcauggaagacaauggcuaugguacugucaaucguaucucucuuuccuuuaugucugucuacgaccucccaaaaaacaacauggcuuccggugcuguuaggaucuuuuggaugcaaaccauuaaccauguuucucauaacagaaaacaaaaucuggggaaggaaaaguuggccccucaaugaaggaauuauggccauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguauccugggaagaagaagcagaacacuccgguaccucacacaacauauuaguagagguccaagaugauggaacuaugaaaauaaaagaugaagagagggaugacacacucaccauccuccucaaagcaacucugcuggcaguuucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuauugggcaggucccaagugggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacucccgaaggugaaguuggagccguagcucuagauuuuaaacccggcacaucuggaucucccauugugaacagagagggaaaaauaguaggucuuuauggaaauggaguggugacaacaaguggaaccuacgucagugcuauugcccaagcuaaagcaucacaagaagggccccuaccagagauugaggacgagguguuuaagaaaagaaacuuaacaauaauggaccugcauccaggaucaggaaaaacaagaagauaucuuccagccauaguccgugaggccauaaaaaggaaacugcgcacguuaaucuuggcucccacaagaguugucgccucugaaauggcagaagcgcucaagggaaugccaauaagauaucagacaacagcagugaagagugaacacacaggaagggagauaguugaucucaugugccacgccacuuuuaccaugcgucucuuaucuccagugagaguucccaauuacaacaugauuaucauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaagaaagagacauuccugagagaucauggaacucaggcuacgauuggaucacugauuuuccagguaaaacagucugguuuguuccaagcauuaaaucaggaaaugacauugccaacuguuuaagaaagaacggaaaacgggugauccaauugagcagaaaaaccuuugacaccgaguaccagaaaacaaaaaacaaugacugggacuauguugucacaacagacauuuccgaaaugggagcaaauuucagggccgacaggguaauagacccaaggcggugcuugaaaccgguaauacuaaaagaugguccagagcgcgucauuuuagcuggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaacauaaacacaccagaagggaucaucccagcccucuuugagccagagagagaaaagagcgcagcaauagacggggaguacagacugcggggagaagcaaggaaaacguucguggagcucaugagaagaggagaucuaccaguuuggcuauccuacaaaguugccucagaagguuuucaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguucaaagaguuugcagcaggaagaagaagugucucaggugaccuaaucuuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugaugcuguucuuccuaucaggaaaaggucuagggaaaacauccaucggccugcucugugugauggccucaagcgcacuguuauggauggccaguguggagccccauuggauagcggccuccaucauacuagaguucuuucuaauggugcugcucauuccagagccagacagacagcgcacuccacaggacaaccagcuagcguauguagugauagguuuguuauucaugauacugacaguggcagccaaugagaugggauuauuggaaaccacaaagaaagaccuggggauuggccauguagccgccgaaaaccaccaccacguuacaaugcuggacguagaccuacguccagcuucagccuggacccucuaugcgguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcggugcugauguuaguggcucauuaugccauaauuggaccaggacugcaagcaaaggccacuagagaagcucaaaaaaggacagcggccggaauaaugaaaaauccaaccguagaugggauuguugcaauagacuuggauccugugguuuaugaugcaaaauuugaaaaacagcuaggccaaauaauguuacugauacuuuguacaucacagauucucuugaugcggaccacaugggccuugugugaguccaucacacuggcuaccggacccuugaccacucucugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagaucugaagccaaagagggauugaaaagaggagaaacaaccaaacaugcagugucgagaggaacagccaaacugaggugguuuguggagaggaaccuugugaaaccagaagggaaagucauagaucucgguuguggaagagguggcuggucauauuauugugcugggcugaagaaagucacugaagugaagggauacacaaaaggaggaccugggcaugaggaaccuaucccaauggcgacuuauggauggaaccuaguaaagcuacacucuggaaaagauguauuuuuuacaccaccugagaaaugugauacccuucugugugauauuggugaguccucuccgaauccaacuauagaagaaggaagaacguuacguguucuaaagaugguggaaccauggcuuggaggaaaccaauuuugcauaaaaauccuaaauccuuauaugccaagugugguagaaacucuggagcaaaugcaaaggaaacauggagggaugcuagugagaaacccacucucaagaaauuccacccaugaaauguacuggguuucauguggaacaggaaacauugugucggcagugaacaugacauccagaauguuacugaaucgauucacaauggcgcauaggaagccaacauaugaaagagacguggacuuaggcgcuggaacaagacauguggcaguggaaccagagguagccaaccuagguaucauuggccagagaauagagaauauaaaaaaugaacacaagucaacauggcauuaugaugaagacaauccauacaaaacaugggccuaucauggaucauaugaggucaagccaucaggaucagccucaucuauggugaauggcguggugagauugcucacaaaaccaugggauguuauccccauggucacacaaauagcuaugacugauaccacacccuucggacaacagagaguguuuaaagagaaaguugauacgcgcacaccaagagcaaaacgaggcacagcacaaauuauggaggugacagccaaaugguuaugggauuuccuuuccagaaacaaaaaacccagaaucugcacaagagaggaguucauaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugcgccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguucaguagagagaauucacucaguggaguggaaggagaaggacugcacaaacuuggauacauacucagagacauaucaaagauuccggggggaaacauguaugcagaugauacagccggaugggacacaagaauaacagaggaugaucuucagaaugaggcuaaaaucacugacaucauggagccugaacaugcucuauuggcuacgucaauuuuuaagcuaaccuaccaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaacuagaaaccacuaaucuagcugagagaguucuugacugguuggaaaaacauggugucgaaaggcugaaaagaauggcaauuaguggagaugauuguguggugaaaccaauugaugacagguucgcaacagccuuaauagcucugaaugacaugggaaaaguaagaaaagacauaccgcagugggaacccucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauacgcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauagggucuggauagaggaaaacccauggauggaggacaaaacucauguauccaguugggaagaaguuccauaccuagggaaaagggaagaucaaugguguggaucucugauaggcuugacagcgagggccaccugggccaccaacauacaaguagccauaaaccaagugagaaggcucauugggaaugagaauuaucuagauuacaugacaucaaugaagagauucaagaaugagagugaucccgaaggggcacucugguaa

SEQ ID NO: 5580 - RNA, 9879 nt, Artificial Sequence
  derived and/or modified CDS sequence (wt) from DENV-1__FJ562106__SS-prME
uccgugaccaugcuccucaugcugcugcccacagcccuggcuuuccauuugaccacacgagggggagagccacacaugauaguuaguaagcaggaaagaggaaagucacucuuguucaagaccucugcaggugucaauaugugcacucucauugcgauggauuugggagaauuaugugaggacacaaugaccuacaaaugcccccggaucacugaggcggaaccagaugacguugacugcuggugcaaugccacagacacaugggugaccuaugggacgugcucucaaaccggugaacaccgacgagacaaacguuccguggcacuggccccacacgugggacuuggucuagaaacaagaaccgaaacauggauguccucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcugguaacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaauugugcauugaagcuaaaauaucaaacaccaccaccgauucaagauguccaacacaaggagaggcuacacugguggaagaacaagacgcgaacuuugugugucgacgaacguuuguggacagaggcugggguaauggcugcggacuauuuggaaaaggaagccuacugacgugugcuaaguucaagugugugacaaaacuggaaggaaagauaguucaauaugaaaacuuaaaauauucagugauagucacuguccacacaggggaccagcaccaggugggaaacgagacuacagaacauggaacaauugcaaccauaacaccccaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucaggggcuucaacaucccaagagacuuggaacagacaagauuugcuggucacauucaagacagcucaugcaaagaagcaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauaugugaugugcacaggcucauuuaagcuagagaaggaaguggcugagacccagcauggaacuguccuagugcagguuaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucaugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacgucugugggaaaauugguacaccagguuuuuggaaccgcauacgggguucuguucagcgguguuucuuggaccaugaaaauaggaauagggauccugcugacaugguugggauuaaauucaaggagcgcgucgcuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugaucaggccacaacccauggaacacaaauacucauggaaaagcuggggaaaagccaaaaucauaggagcagacauacagaauaccaccuucaucaucgacggcccagauacuccagaaugccccgaugaccaaagagcguggaacauuugggaaguugaggacuauggguuuggaauuuucacgacaaacauauggcugaaauugcgugacuccuacacccaaaugugugaccaucggcuaaugucagcugccaucaagaacagcaaggcaguccaugcugacaugggguacuggauagaaagugaaaagaacgagaccuggaagcuagcgagagccuccuucauagaagucaagacaugcauuuggccgaaaucccacacucuauggaguaauggaguuuuggaaagugaaaugauaaucccaaagauauauggaggaccaauaucucagcacaauuacagaccaggguauuucacacaaacagcagggccauggcaccuaggcaaguuggaauuggauuuuggcuugugcgaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuucucauugggaauacuaugcguaucaauaaugauugaagaagugaugagauccagauggaguagaaagaugcugaugacuggaacauuggcuguuuuccuccuucuuauaaugggacaacugacauggaaugaucugauuagguuaugcaucaugguuggagcuaaugcuucugacaggauggggaugggaacaacguaccuagccuugauggcuacuuucaaaaugagaccaauguucgccguuggguuauuauuucgcagacuaacauccagagagguucuucuucucacgauuggauuaagccugguggcauccguggagcuaccaaauucuuuggaggaacuaggggauggacuugcaauggguaucaugauguuaaaauuauugacugaauuucagccacaccaguuauggaccaccuuacugucucugacauuuaucaaaacaacuuuuucauuggauuaugcauggaagacaauggcuaugguacugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuagccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaagugggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacucccgaaggcgaaguuggagccauagcucuagauuuuaaacccggcacaucuggaucucccauugugaacagagagggaaaaauaguaggucuuuauggaaauggaguggugacaacaaguggaaccuacgucagugccauugcccaagcuaaagcaucacaagaagggccccuaccagagauugaggacgagguguuuaagaaaagaaacuuaacaauaauggaccugcauccaggaucaggaaaaacaagaagauaucuuccagccauaguucgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacccgaguagguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacgggugauccaauugagcagaaaaaccuuugacacugaguaccagaaaacaaaaaacaaugacugggacuauguugucacaacagacauuuccgaaaugggggcaaauuucagggccgacaggguaauagacccaaggcggugcuugaaaccgguaauacuaaaagaugguccagagcgcgucauucuagcuggaccgaugccagugacuguggccagugcugcccagaggagaggaagaauuggaaggaaccaaaacaaggaaggugaucaguauguuuacaugggacagccuuuaaauaaugaugaggaucacgcccauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaguguggagccccauuggauagcggccuccaucauacuagaguucuuucugauggugcugcucauuccagagccagacagacagcgcacuccacaggacaaccaguuagcauauguggugauagguuuguuauucaugauacugacaguggcagccaaugagaugggauuauuggaaaccacaaagaaagaccuggggauuggccauguagccgccgaaaaccaccaccaugcuacaaugcuggacguagaccuacguccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauucucuugaugcggaccacaugggccuugugugaauccaucacacuggcuacaggacccuugaccacucucugggagggaucuccaggaaaauucuggaauacuacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagaucugaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggagccuaucccaauggcgaccuauggauggaaucuaguaaagcuacacucuggaaaagauguauuuuuuacaccaccugagaaaugugauacccuucugugugauauuggugaguccucuccgaauccaacuauagaagaaggaagaacguuacguguucuaaagaugguggaaccauggcuuagaggaaaccaauucugcauaaaaauccuaaauccuuacaugccaagugugguagaaacucuggagcaaaugcaaagaaaacauggagggaugcuagugagaaacccacucucaagaaauuccacccaugaaauguacuggguuucauguggaacaggaaacauugugucggcagugaacaugacauccagaauguuacugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugaggucaagccaucaggaucagccucaucuauggugaauggcguggugagauugcucacaaaaccaugggauguuauccccauggucacacaaauagcuaugacugauaccacacccuucggacaacagagaguguuuaaagagaaaguugacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguucaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaaucuuuaagcugaccuaccaaaacaagguggugagggugcaaagaccagcaaaaaauggaaccgugauggauguuauauccagacgugaccagagaggaaguggacaagucggaacuuauggcuuaaauacuuucaccaauauggagguccaacuaauaagacaaauggagucugaaggaaucuuuuuacccugcgaauuggaaacccccaaucuagcugagagaguucuugacugguuggaaaaacauggcgccgaaaggcugaaaagaauggcaauuaguggagaugauuguguggugaaaccaauugaugacagguucgcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuuguggguagggcuagaguaucacaaggcgccggauggagccugagagaaacugcuugccuaggcaagucauacgcacaaauguggcagcugauguacuuccacaggagagaccugagacuagcggcuaaugcuaucuguucagccgucccaguugauugggucccaaccagccgcacaaccuggucaauccaugcccaccaccaauggaugacgacagaagacauguuaucaguguggaauaggguuuggauagaggaaaacccauggauggaggacaaaacucauguguccaguugggaagaaguuccauaccuagggaaaagggaagaucaauggugcggaucucugauaggcuugacaacgagggccaccugggccaccaacauacaaguagccauaaaccaagugagaaggcucaucgggaaugagaauuaccuagauuacaugacaucaaugaagagauucaagaaugagagugaucccgaaggggcacucugguaa

SEQ ID NO: 5581 - RNA, 9879 nt, Artificial Sequence
  derived and/or modified CDS sequence (wt) from DENV-1__FJ410179__SS-prME
ucugugaccaugcuccucaugcugcugcccacagcccuggcguuccauuugaccacacgagggggagagccacacaugauaguuaguaagcaggaaagaggaaagucacuguuguuuaagaccucugcaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacauguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgaugugugggaauaggcaacagagacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacauagauacucauggaaaagcuggggaaaagccaaaaucauaggagcagacauacagaauagcaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaggcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauguauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgaggcccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuaugcguaucaauaaugauugaagaagugaugagauccagauggaguagaaagaugcugaugacuggaacauuggcuguuuuccuccuucuuauaaugggacaacugacauggaaugaccugauuagguuaugcaucaugguuggagcuaaugcuucagacaggauggggaugggaacaacguaccuggccuugauggcuacuuucaaaaugagaccaauguucgcuguugggcuacuauuucgcagacuaacauccagagaaguucuucuucucacgauuggauuaagccugguggcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuggccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcaaucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaagugggagugggaguuuuccaagacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagccguugaaccaggaaaaaauccuaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggaggagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaagcaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaagaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugccucagaagguuuccaguacuccgacagaagguggugcuuugacggggaaaggaacaaccagguguuggaggagaacauggacguggagaucuggacaaaggaaggagaaaggaagaaauugcgaccccgcugguuggaugccagaacauacucugauccacuggcccuucgugaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacacugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggccauguagccgccgaaaaccaacaccaugccacgaugcuggacguagaccuacgcccagcuucagccuggacccucuaugcaguagccacaacaguuaucacucccaugaugagacacacaauugaaaacacaacagcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggcccugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauucuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaagccaacauaugaaagagacguggacuuaggcgcuggaacaagacauguggcaguggaaccagagguagccaaccuagauauuauuggccagaggauagagaauauaaaaaaugaacauaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggcuaaaaucacugacaucauggagccugaacacgcucuauuggcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuugacugguuggaaaaacauggcacugaaagacugaaaagaauggcaauuagcggagaugauuguguggugaaaccaguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacugggucccaaccagucgcacaaccuggucaauccaugcucaccaucaauggaugacaacagaagacauguuaucaguguggaauaggguuuggauagaggaaaacccauggauggaggauaaaacucauguauccagcugggaagaagucccauacuuagggaaaagggaagaucaaugguguggaucccugauaggcuugacagcgagggccacuugggccacuaacauacaaguagccauaaaccaagugagaaggcucaucgggaaugagaauuaucuagauuacaugacaucaaugaagagauucaagaaugagagugaucccgaaggggcacucugguaa

SEQ ID NO: 5582 - RNA, 9879 nt, Artificial Sequence
  derived and/or modified CDS sequence (wt) from DENV-1__FJ410181__SS-prME
ucugugaccaugcuccucaugcugcugcccacagcccuggcguuccauuugaccacacgagggggagagccacacaugauaguuaguaagcaggaaagaggaaagucacuguuguuuaagaccucuguaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgaugugugggaauaggcaacagagacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggcuacacugguggaagaacaagacucgaacuuugugugucgacgaacguuuguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugacugacuacggagcccucacauuggacugcucgccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcgggacaccugaaaugcagacuaaaaauggauaaacugacuuuaaaggggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugauaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccauauucuacuugaaaaugacaugaaauucacagugguuguaggagaugcuaauggaauuuuggcccaagggaaaaaaaugauuaggccacaacccauggaacauagauacucauggaaaagcuggggaaaagccaaaaucauaggagcagacauacagaauaccaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaaugucagcugccaucaaagacagcaaggcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaagcuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguagacaguuuuucacuagggauacuaugcguaucaauaaugauugaagaagugaugagauccagauggaguagaaagaugcugaugacuggaacauuggcuguuuuccuccuucuuauaaugggacaacugacauggaaugaucugauuagguuaugcaucaugguuggagcuaaugcuucagacaggauggggaugggaacaacguaccuggccuugauggcuacuuucaaaaugagaccaauguucgcuguugggcuauuauuucgcagacuaacauccagagaaguucuucuucucacgauuggauugagccuaguggcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuagccggcccacuaauagcuggaggcaugcuaauagcauguuaugucauaucuggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuucgugugguacuuuuggcagaaaaagaaacagagaucaggaguguuaugggacacacccagcccuccggaaguggaaagagcaguucuugaugauggcaucuauagaauccugcaaagaggacuguugggcaggucccaaguaggagugggagucuuccaagacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagcuguugaaccaggaaaaaaucccaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggacgagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaagcaaugcaguuauccaagaugaggaaagagacauuccugagagaucauggaacucaggcuacgacuggaucacugauuuuccagguaaaacagucugguuuguuccaagcauuaagucaggaaaugacauugcuaacugcuuaagaaagaacggaaaacgggugauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauugauggggaguacagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccuucgugaguucaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggccauguagccgccgaaaaccaacaccaugccacgaugcuggacguagaccuacgcccagcuucagccuggacccucuaugcaguagccacaacaguuaucacuccuaugaugagacacacaauugaaaacacaacggcaaacauuucccugacagccauugcaaaccaggcagcuauauugaugggacuugacaagggauggccaauaucgaagauggacauaggaguuccacuucucgccuuagggugcuauucccaagugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggccuugugugaauccaucacacuggcuacuggacccuugaccacucucugggagggaucuccaggaaaauuuuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugacauaggagaguccucuccgaauccaacuauagaagaaggaagaacguuacguguucuaaagaugguagaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacuaaaucgauucacaauggcucacaggaagccaacauaugaaagagacguggacuuaggcgcuggaacaagacauguggcaguggaaccugagguagccaaccuagauaucauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguggacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucguguacagagagagggagcuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaauauguaugcagaugacacagccggaugggacacaagaauaacagaggaugaucuucagaaugaggcuaaaaucacugacaucauggagccugaacacgcucuauuggcuacgucgauuuuuaagcugaccuaccaaaacaaggugguaagggugcaaagaccagcaaaaaauggaaccgugauggauguuauauccagacgagaucagagaggaagugggcaggucggaaccuauggcuuaaauacuuucaccaauauggagguccaacuaauaagacaaauggagucugaaggaaucuuuuuacccagcgaacuggaaacccccaaucuagcugagagaguucuugacugguuggaaaaacauggcaccgaaaggcugaaaagaauggcaauuagcggagaugauuguguggugaaaccgguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauacgcacaaauguggcagcugauguacuuccacaggagagaccuaagacuagcggcuaaugcuaucuguucagcugucccaguugacugggucccaaccagccgcacaaccuggucaauccaugcucaccaucaauggaugacaacagaagauauguuaucaguguggaauaggguuuggauagaggaaaacccauggauggaggauaaaacucacguguccagcugggaagaagucccauacuuagggaaaagggaagaucaaugguguggaucccugauaggcuugacagcgagggccacuugggccacuaacauacaaguagccauaaaccaagugagaaggcucaucgggaacgagaauuaucuagauuacaugacaucaaugaagagauucaagaaugagagugaucccgaaggggcacucugguaa

SEQ ID NO: 5583 - RNA, 9879 nt, Artificial Sequence
  derived and/or modified CDS sequence (wt) from DENV-1__FJ547086__SS-prME
uccgugaccaugcuccuuaugcugcugcccacagcccuggcuuuccauuugaccacacgagggggagagccacacaugauaguuaguaagcaggaaagaggaaagucacucuuguucaagaccucugcaggugucaauaugugcacucucauugcgauggauuugggagaauuaugugaggacacaaugaccuacaaaugcccccggaucacugaggcggaaccagaugacguugacugcuggugcaaugccacagacacaugggugaccuaugggacgugcucucaaaccggugaacaccgacgagacaaacguuccguggcacuggccccacacgugggacuuggucuagaaacaagaaccgaaacauggauguccucugaaggcgccuggaaacaaauacaaaaaguggagacuugggcuuugagacacccaggauucacggugauagccuuuuuuuuagcacaugccauaggaacauccaucacucagaaagggaucauuuucauuuugcugaugcugguaacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaauugugcauugaagcuaaaauaucaaacaccaccaccgauucaagauguccaacacaaggagaggcgacacugguggaagaacaagacgcgaacuuugugugucgacgaacguuuguggacagaggcugggguaauggcugcggacuauuuggaaaaggaagccuacugacgugugcuaaguucaagugugugacaaaacuggaaggaaagauaguucaauaugaaaacuuaaaauauucagugauagucacuguccacacaggggaccagcaccaggugggaaacgagacuacagaacauggaacaauugcaaccauaacaccccaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuuguuggucacauucaagacagcucaugcaaagaagcaggaaguagucguacugggaucacaggaaggagcaaugcacacugcguugacuggggcgacagaaauccagacgucaggaacgacaacaaucuuugcaggacaccugaaauguagacuaaaaauggauaaacugacuuuaaaagggaugucauaugugaugugcacaggcucauuuaagcuagagaaggaaguggcugagacccagcauggaacuguccuagugcagguuaaauacgaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucaugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacgucugugggaaaguugguacaccagguuuuuggaaccgcauacgggguucuguucagcgguguuucuuggaccaugaaaauaggaauagggauccugcugacaugguugggauuaaauucaaggagcgcgucgcuuucgaugacgugcauugcaguugguaugguuacacuguaccuaggagucaugguucaagcggacucgggaugugcaaucaacuggaagggcagagaacucaaauguggaaguggcauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugaucaggccacaacccauggaacacaaauacucauggaaaagcuggggaaaggccaaaaucauaggagcagacauacagaauaccaccuucaucaucgacggcccagauacuccagaaugccccgaugaccaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagucaagacaugcauuuggccgaaaucccacacucuauggaguaauggaguuuuggaaagugaaaugauaaucccaaagauauauggaggaccaauaucucagcacaauuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucugacaggauggggaugggaacaacguaccuagccuugauggcuacuuucaaaaugagaccaauguucgccguuggguuauuauuucgcagacuaacauccagagagguucuucuucucacgauuggauuaagccugguggcauccguggagcuaccaaauucuuuggaggaacuaggggauggacuugcaauggguaucaugauguuaaaauuacugacugaauuucagccacaccaguuauggaccaccuuacugucucugacauuuaucaaaacaacucuuucauuggauuaugcauggaagacaauggcuaugguacugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuagccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaagugggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacucccgaaggcgaaguuggagccauagcucuagauuuuaaacccggcacaucuggaucucccauugugaacagagagggaaaaauaguaggucuuuauggaaauggaguggugacaacaaguggaacuuacgucagugccauugcccaagcuaaagcaucacaacaagggccccuaccagagauugaggacgagguguuuaagaaaagaaacuuaacaauaauggaccugcauccaggaucaggaaaaacaagaagauaucuuccagccauaguucgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacccgaguagguaugggugaagcagcugcgaucuuuaugacagcaacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacgggugauccaauugagcagaaaaaccuuugacacugaguaccagaaaacaaaaaacaaugacugggacuauguugucacaacagacauuuccgaaaugggggcaaauuucagggccgacaggguaauagacccaaggcggugcuugaaaccgguaauacuaaaagaugguccagagcgcgucauucuagcuggaccgaugccagugacuguggccagugcugcccagaggagaggaagaauuggaaggaaccaaaacaaggaaggugaucaguauguuuacaugggacagccuuuaaauaaugaugaggaucacgcccauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcuguacugacugguggagugacgcuguucuuccuaucaggaaaaggucuagggaaaacauccauuggccugcucugugugauggccucaagcgcacuguuauggauggccaguguggagccccauuggauagcggccuccaucauacuagaguucuuucugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaucaugcuacaaugcuggacguagaccuacguccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauucucuugaugcggaccacaugggccuugugugaauccaucacacuggcuacaggacccuugaccacucucugggagggaucuccaggaaaauucuggaauacuacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagaucugaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuacaccaccugagaaaugugauacccuucugugugauauuggugaguccucuccgaauccaacuauagaagaaggaagaacguuacguguucuaaagaugguggaaccauggcuuagaggaaaccaauucugcauaaaaauccuaaauccuuacaugccaagugugguagaaacucuggagcaaaugcaaagaaaacauggagggaugcuagugagaaacccacucucaagaaauuccacccaugaaauguacuggguuucauguggaacaggaaacauugugucggcagugaauaugacauccagaauguuacugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaacccauacaaaacaugggccuaucauggaucauaugaggucaagccaucaggaucagccucaucuauggugaauggcguggugagauugcucacaaaaccaugggauguuauccccauggucacacaaauagcuaugacugauaccacacccuucggacaacagagaguguuuaaagagaaaguugacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugcgccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguucaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaaaguggugagggugcaaagaccagcaaaaaauggaaccgugauggauguuauauccagacgugaccagagaggaaguggacaagucggaacuuauggcuuaaauacuuucaccaauauggagguccaacuaauaagacaaauggagucugaaggaaucuuuuuacccugcgaauuggaaacccccaaucuagcugagagaguucuugacugguuggaaaaacauggcgccgaaaggcugaaaagaauggcaauuaguggagaugauuguguggugaaaccaauugaugacagguucgcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuuguggguagggcuagaguaucacaaggcgccggauggagccugagagaaacugcuugccuaggcaagucauacgcacaaauguggcagcugauguacuuccacaggagagaccugagacuagcggcuaaugcuaucuguucagccgucccaguugauugggucccaaccagccgcacaaccuggucaauccaugcccaccaccaauggaugacgacagaagacauguuaucaguguggaauaggguuuggauagaggaaaacccauggauggaggacaaaacucauguauccaguugggaagaaguuccauaccuagggaaaagggaagaucaaugguguggaucucugauaggcuugacagcgagggccaccugggccaccaacauacaaguagccauaaaccaagugagaaggcucaucgggaaugagaauuaccuagauuacaugacaucaaugaagagauucaagaaugagaguaaucccgaaggggcacucugguaa

SEQ ID NO: 5584 - RNA, 9879 nt, Artificial Sequence
  derived and/or modified CDS sequence (wt) from DENV-1__FJ410183__SS-prME
ucugugaccaugcuccucaugcugcugcccacagcccuggcguuccauuugaccacacgagggggagagccacacaugauagucaguaagcaggaaagaggaaagucacuguuguucaagaccucugcaggcaucaacaugugcacucucauugcgauggauuugggagaguuaugcgaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagagacaagaaccgaaacauggauguccucugaaggugccuggaaacaaauacaaaaaguggagacuugggcuuugagacacccaggauucacggugacagccuuuuuuuuagcacaugccauaggaacauccauuacucagaaagggaucauuuucauuuugcugaugcuaguaacaccaucaauggccaugcgaugugugggaauaggcaacagagacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggcuacacugguggaagaacaagacucgaacuuugugugucgacgaacguuuguggacagaggcugggguaauggcugcggacuauuuggaaaaggaagccuacugacgugugcuaaguucaagugugugacaaaacuggaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugacugacuacggagcucucacauuggacugcucgccuagaacagggcuggacuuuaaugagauggugcuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauaugugaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugaguugguucaagaaagggaguagcauagggaaaauguucgaagcaacugcccgaggagcacgaaggauggcuauccugggagacaccgcaugggacuuuggcucuauaggaggaguguucacaucagugggaaaauugguacaccaggucuuuggagccgcauaugggguucuauucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugaucaggccacaacccauggaacauagauacucauggaaaagcuggggaaaagccaaaaucauaggagcagacauacagaauaccaccuucaucaucgacggcccagauacuccagaaugccccgaugaccaaagagcguggaacauuugggaaguugaagacuauggguuuggaauuuucacgacaaacauauggcuaaaauugcgcgacuccuacacccaaaugugugaccaccggcuaaugucagcugccaucaaagacagcaaggcaguccaugcugacaugggguacuggauagaaagugaaaagaacgagaccuggaagcuggcgagagccuccuucauagaagucaagacauguaucuggccgaaaucccacacucuauggagcaauggaguuuuggaaagugaaaugauaaucccaaagauguauggaggaccaacaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaauggacaguuuuucacuagggauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuggccuugauggcuacuuucaaaaugagaccaauguucgcuguugggcuauuauuucgcagacuaacauccagagaaguucuucuucucacgauuggauuaagccugguggcauccguggaguuaccaaauucuuuggaggagcuaggggauggacuugcaauggguaucaugauguuaaaauuauugacugaauuccagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggccauuggaauagucagcauucuacuaaguucacuccuuaaaaaugaugugccguuagccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaaccaugaaaauaaaagaugaagagagggaugacacgcucaccauacuccucaaagcaacucugcuggcagucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaaguaggagugggaguuuuccaagacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagcuguugaaccaggaaaaaaucccaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggacgagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuucaccaugcgucucuuaucuccagugagaguucccaauuacaacaugauuaucauggaugaagcacauuuuaccgauccagccagcauagcggccagaggguacaucucgacucgaguggguaugggugaagcagcugcgaucuuuaugacagccacucccccaggaucgguggaggccuuuccacaaagcaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaccacgcucauuggacagaagcaaaaaugcuccuugacaauauaaacacaccagaagggaucauuccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguagagaucuggacaaaggaaggagaaagaaagaaauugcgaccccgcugguuggaugccagaacauacucugauccacuggcccuucgugaguucaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuucuaucaggaaaaggacuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucauaauacugacaguggcagccaaugagaugggacuauuggaaaccacaaagaaagaccuggggauuggccauguagccgccgaaagccaacaccaugccacgaugcuggacguagaccuacgcccagcuucagccuggacccucuaugcaguagccacaacaguuaucacucccaugaugagacacacaauugaaaacacaacggcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucuccugaugcggaccacaugggccuugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaauccuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagagucuucuccgaauccaaccauagaagaaggaagaacguuacguguucuaaagaugguagaaccauggcuuagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguagacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaauauguaugcagaugacacagccggaugggacacaagaauaacagaggaugaucuucagaaugaggcuaaaaucacugacaucauggagccugaacacgcucuauuggcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuugacugguuggaaaaacauggcaccgaaaggcugaaaagaauggcaaucagcggagaugauuguguggugaaaccaguugaugacagguuugcaacagccuuaauagcucugaaugacaugggaaaaguaagaaaagauauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagcugucccaguugacugggucccaacuagccgcacaaccuggucaauccaugcucaccaucaauggaugacaacagaagacauguuaucaguguggaauaggguuuggauagaggaaaacccauggauggaggacaaaacucauguauccagcugggaagaagucccauacuuagggaaaagggaagaucaaugguguggaucccugauaggcuugacagcgagggccacuugggccacuaacauacaaguagccauaaaccaagugagaaggcucaucgggaaugagaauuaucuagauuacaugacaucaaugaagagauucaagaaugagagugaucccgaaggggcacucugguaa

SEQ ID NO: 5585 - RNA, 9879 nt, Artificial Sequence
  derived and/or modified CDS sequence (wt) from DENV-1__FJ410184__SS-prME
ucugugaccaugcuccucaugcugcugcccacagcccuggcguuccauuugaccacacgagggggagagccacauaugauaguuaguaagcaggaaagaggaaagucacuguuguuuaagaccucugcagguaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaaaaguggagacuugggcuuugagacacccaggauucacggugauagcccuuuuuuuagcacaugccauaggaacauccaucacucagaaagggaucaucuucaucuugcugaugcuaguaacaccaucaauggccaugcgaugugugggaauagguaacagagacuucguugaaggacugucaggagcaacguggguggacgugguauuggagcauggaagcugcgucaccaccauggcaaaagauaaaccaacauuggacauugaacuccugaagacggaggucacgaacccugccguccugcgcaaacugugcauugaagcuaaaauaucaaacaccaccaccgauucaagguguccaacacaaggagaggcuacacugguggaagaacaagacgcgaacuuugugugucgacgaacguuuguggacagaggcugggguaauggcugcggacuauuuggaaaaggaagccuacugacgugugcuaaguucaagugugugacgaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugacugacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggagcuucaacaucucaagagacuuggaacagacaagauuugcuggucacauucaagacagcucaugcaaagaaacaggaaguagucguacugggaucacaagagggagcaaugcacacugcguugacuggagcgacagaaauccagacgucgggaacgacaacaaucuuugcaggacaccugaaaugcagacuaaaaauggauaaacugacuuuaaaagggaugucauaugugaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaaccgcccgaggagcacgaaggauggcuauccugggagacaccgcaugggacuuugguucuauaggaggaguguucacgucagugggaaaauugguacaccagguuuuuggaaccgcauaugggguuuuguucagcgguguuucuuggaccaugaaaauaggaauagggauucuacugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacacgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacagauacucauggaaaagcuggggaaaagccaaaaucauaggagcagacauacagaauaccaccuucaucaucgacggcccagauacuccagaaugccccgaugaccaaagagcguggaacauuugggaaguugaggacuauggguuuggaauuuucacgacaaacauauggcugaaauugcgcgacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagucaagacaugcaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagagggaggaaaaccuaguuaagucaauggucucugcaggguuaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuggccuugauggcuacuuucaaaaugagaccaauguucgcuguugggcuauuauuucgcagacuaacauccagagaaguucuucuucucacgauuggauuaagccugguagcauccguggaguuaccaaauucuuuggaggagcuaggggauggacuugcaauggguauuaugauguuaaaauuauugacugaauuucagccacaccaguuauggaccaccuuacugucuuugacauuuaucaaaacaacucuuucauuggauuaugcauggaagacaauggcuauggugcugucaaucguaucucucuuuccuuuaugucuuucuacgaccucccaaaaaacaacauggcuuccgguguuguuaggaucucuuggaugcaaaccauuaaccauguuucuuauaacagaaaacaaaauuuggggaaggaaaaguuggccccucaaugaaggaauuauggcuauuggaauagucagcauucuacuaaguucacuccuuaaaaaugaugugccguuagccggcccacuaauagcuggaggcaugcuaauagcauguuacgucauauccggaagcucagccgauuuaucauuggagaaagcggcugagguauccugggaagaagaagcagaacacucuggcaccucacacaacauauugguagagguccaagaugauggaacuaugaaaauaaaagaugaagagagggaugacacacucaccauacuccuuaaagcaacucugcuggcagucucaggaguguacccaaugucaauaccagcaacucuuuucgugugguauuuuuggcagaaaaagaaacagagaucaggaguguuaugggacacgcccagcccuccagaaguggaaagagcaguucuugaugauggcaucuauagaauccugcaaagaggacuguugggcaggucccaaguaggagugggaguuuuucaagacggcguguuccacacaauguggcacgucaccaggggagcuguucuuauguaccaagggaagaggcuggaaccaagcugggccagugucaaaaaggacuugaucucauauggaggagguuggagguuucaaggagcauggaacacgggagaagaagugcaggugauagcuguugaaccaggaaaaaaccccaaaaauguacagacaacgccgggcaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggucucuaccagagauugaggacgagguguuuaagaaaaggaacuuaacaauaauggaccugcauccaggaucaggaaaaacaagaagauaucuuccagccauaguccgugaggccauaaaaaggaaacugcgcacguuaaucuuggcucccacaagaguuguugccucugaaauggcagaggcgcucaagggaaugccaauaagauaucagacaacagcagugaagagugaacacacaggaagggagauaguugaccucaugugccacgccacuuuuaccaugcgucucuuaucuccaguaagaguucccaauuacaacaugauuaucauggaugaagcacauuuuaccgauccagccagcauagcagccagaggguacaucucaacccgaguggguaugggugaagcagcugcgaucuuuaugacagccacucccccaggaucgguggaggccuuuccacaaagcaaugcaguuauccaagaugaggaaagagacauuccugagagaucauggaacucaggcuacgacuggaucacugauuuuccagguaaaacagucugguuuguuccaagcaucaaaucaggaaaugacauugcuaacuguuuaagaaaaaacggaaaacgggugauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagaggagaggaagaauuggaaggaaccaaaacaaggaaggugaucaguacguuuacaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguauagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccuucgugaguucaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagcuuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaguguggagccccauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggacuauuggaaaccacaaagaaagaccuggggauuggcuauguagccgccgaaaaccaccaccaugccacaaugcuggacguagaccuacguccagcuucagccuggacccucuaugcaguagccacaacagucaucacucccaugaugagacacacaauugaaaauacaacggcaaacauuucccugacagccauugcaaaccaggcggcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuacgaugcaaaauuugaaaaacaguuaggccaaauaauguuacugauacuuuguacaucacagauucucuugaugcggaccacaugggccuugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuuaggaggaggcaggagagguacaggggcucaaggagaaacacugggagagaaauggaaaagacaguuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagagaaaccucgugaaaccagaagggaaagucauagaccucgguuguggaagagguggcuggucauauuauugugcugggcugaagaaagucacugaagugaaaggauauacaaaaggaggaccuggacaugaggaaccuaucccaauggcgaccuauggauggaaccuaguaaagcuacacucuggaaaagauguauuuuuuacaccaccugagaaaugugauacccuucugugugacauuggagaguccucuccgaauccaacuauagaagaaggaagaacguuacguguucuaaagaugguagaaccauggcucagaggaaaccaauucugcauaaaaauccuaaauccuuacaugccaaguguuguagaaacucuggagcaaaugcaaagaaaacauggagggaugcuagugcgaaauccacucucaagaaauuccacucaugaaauguacuggguuucauguggaacaggaaacauugugucagcagugaacaugacauccagaauguuacugaaucgauucacaauggcucacaggaagccaacauaugaaagagacguggacuuaggcgcugggacaagacauguggcaguggagccagagguagccaaccuagauaucauuggccagaggauagagaauauaaaaaaugaacacaagucaacauggcauuaugaugaagacaauccauacaaaacaugggccuaucauggaucauaugaggucaaaccaucaggaucagccucaucuauggucaauggcguggugagauugcucacaaaaccaugggauguuauccccauggucacacaaauagccaugacugauacuacacccuucggacaacaaagaguguuuaaagagaaaguugacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagccgugcaauaugguacauguggcugggagcacgcuuucuagaguucgaagcccuugguuucaugaaugaagaucacugguucaguagagagaauucauucaguggaguggagggagaaggacugcacaaacuuggauacauacucagagacauaucaaagauuccggggggaaauauguaugcagaugauacagccggaugggacacaagaauaacagaggaugaucuucagaaugaggcuaaaaucacugacauuauggagccugaacacgcucuauuggcuacgucaauuuuuaagcugaccuaccaaaacaaggugguaagggugcaaagaccagcaaaaaauggaaccgugauggauguuauauccagacgugaccagagaggaagcgggcaggucggaaccuauggcuuaaauacuuucaccaauauggagguccaacuaauaagacaaauggagucugaaggaaucuuuuuacccagcgaauuggaaacccccaaucuagcugagagaguucuugacugguuggaaaaacauggcaccgaaaggcugaaaagaauggcaauuagcggagaugauuguguggugaaaccaguugaugacagguucgcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaaugcuaucuguucagcugucccaguugacugggucccaaccagccgcacaaccuggucaauccaugcucaccaccaauggaugacaacagaagacauguuaucaguguggaauaggguuuggauagaggaaaacccauggauggaggacaaaacucauguaucuagcugggaagaaguuccauaccuaggaaaaagggaagaucaaugguguggaucccugauaggcuugacagcgagggccacuugggccacuaacauacaaguggccauaaaccaagugagaaggcucaucgggaaugagaauuaucuagauuacaugacaucaaugaagagauucaagaaugagagugaucccgaaggggcacucugguaa

SEQ ID NO: 5586 - RNA, 9879 nt, Artificial Sequence
  derived and/or modified CDS sequence (wt) from DENV-1__FJ410185__SS-prME
ucugugaccaugcuccucaugcugcugcccacagcccuggcguuccauuugaccacacgagggggagagccacacaugauaguuaguaagcaggaaagaggaaagucacuguuguuuaagaccucuguaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugauagcccuuuuuuuagcacaugccauaggaacauccauuacucagaaagggaucauuuucauuuugcugaugcuaguaacaccaucaauggccaugcgaugugugggaauaggcaacagagacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacuguguauugaagcuaaaauaucaaacaccaccaccgauucaagguguccaacacaaggagaggcuacacugguggaagaacaagacucgaacuuugugugucgacgaacguuuguggacagaggcugggguaauggcugcggacuauuuggaaaaggaagcuuacugacgugugcuaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugacugacuacggagcccucacauuggacugcucgccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaauugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaagggagugacccagaaugggagauugauaacagccaaccccauagucacugacaaagaaaaaccagucaacauugagacagaaccaccuuuuggugagagcuacaucgugauaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucaggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacauagauacucauggaaaagcuggggaaaagccaaaaucauaggagcagacauacagaauaccaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaaugucagcugccaucaaagacagcaaggcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucaacacaacuacagaccaggguauuucacacaaacagcagggccauggcaucuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguagacaguuuuucacuagggauacuaugcguaucaauaaugauugaagaagugaugagauccagauggaguagaaagaugcugaugacuggaacauuggcuguuuuccuccuucuuauaaugggacaacugacauggaaugaucugauuagguuaugcaucaugguuggagcuaaugcuucagacaggauggggaugggaacaacguaccuggccuugauggcuacuuucaaaaugagaccaauguucgcuguugggcuauuauuucgcagacuaacauccagagaaguucuucuucucacgauuggauuaagccuaguggcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuagccggcccacuaauagccggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaaguaggagugggagucuuccaagacggcguguuccacacaauguggcacgucaccaggggagcuguccuuauguaccaagggaagagguuagaaccaagcugggccagugucaaaaaggacuugaucucauauggaggagguuggagauuucaaggaucauggaacacgggagaagaggugcaggugauagcuguugaaccaggaaaaaaucccaaaaauguacagacaacgccggguaccuucaagacucccgaaggcgaaguuggagccauagcucuagauuuuaaacccggcacaucuggaucucccaucgugaacagagaggaaaaaauaguaggucuuuauggaaauggaguggugacaacaaguggaaccuacgucagugccauugcccaagcuaaaacaucacaagaagggccucuaccagagauugaggacgagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaagcaaugcaguuauccaagaugaggaaagagacauuccugagagaucauggaacucaggcuacgacuggaucacugauuuuccagguaaaacagucugguuuguuccaagcauuaagucgggaaaugacauugcuaacuguuuaagaaagaacggaaaacgggugauccaguugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugccucagaagguuuccaguacuccgacagaaggugguguuuugauggggaaaggaacaaccaaguguuggaggagaacauggacguggagaucuggacaaaggaaggagaaagaaagaaauugcgaccccgcugguuggaugccagaacauacucugauccacuggcccuucgugaguucaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggacuauuggaaaccacaaagaaagaccuggggauuggccauguagccgccgaaaaccaacaccaugccacgaugcuggacguagaccuacgcccagcuucagccuggacccucuaugcaguagccacaacaguuaucacuccuaugaugagacacacaauugaaaacacaacggcaaacauuucccugacagccauugcaaaccaggcagccauauugaugggacuugacaagggauggccaauaucgaagauggacauaggaguuccacuucucgccuuagggugcuauucccaggugaacccauugacacugacagcggcgguguugauguugguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggccuugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaauguuacuaaaucgauucacaauggcucacaggaagccaacauaugaaagagacguggacuuaggcgcuggaacaagacauguggcaguggaaccugagguagccaaccuagauaucauuggccagaggauagagaacauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguggacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaauauguaugcagaugacacagccggaugggacacaagaauaacagaggaugaucuucagaaugaggccaaaaucacugacaucauggagccugaacacgcucuauuggcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuugacuggcuggaaaaacauggcaccgaaaggcugaaaagaauggcaauuagcggagaugauuguguggugaaaccgguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccguaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacugggucccaaccagccgcacaaccuggucaauccaugcucaccaucaauggaugacaacagaagauauguuaucaguguggaauaggguuuggauagaggaaaacccauggauggaggauaaaacucacguauccagcugggaagaagucccauacuuaggaaaaagggaagaucaaugguguggaucccugauaggcuugacagcgagggccacuugggccacuaacauacaaguagccauaaaccaagugagaaggcucaucgggaacgagaauuaucuagauuacaugacaucaaugaagagauucaagaaugagagugaucccgaaggggcacucugguaa

SEQ ID NO: 5587 - RNA, 9879 nt, Artificial Sequence
  derived and/or modified CDS sequence (wt) from DENV-1__FJ547087__SS-prME
uccgugaccaugcuccucaugcugcugcccacagcccuggcuuuccauuugaccacacgagggggagagccacacaugauaguuaguaagcaggaaagaggaaagucacucuuguucaagaccucugcaggugucaauaugugcacucucauugcgauggauuugggagaauuaugugaggacacaaugaccuacaaaugcccccggaucacugaggcggaaccagaugacguugacugcuggugcaaugccacagacacaugggugaccuaugggacgugcucucaaaccggugaacaccgacgagacaaacguuccguggcacuggccccacacgugggacuuggucuagaaacaagaaccgaaacauggauguccucugaaggcgccuggaaacaaauacaaaaaguggagacuugggcuuugagacacccaggauucacggugauagcccuuuuuuuagcacaugccauaggaacauccaucacucagaaagggaucauuuucauuuugcugaugcugguaacaccaucaauggccaugcgaugcgugggaauaggcaacagagacuucguugaaggacugucaggagcaacguggguggacgugguauuggagcauggaagcugcgucaccaccauggcaaaaaacaaaccaacauuggacauugaacucuuaaagacggaggucacgaacccugccgucuugcgcaaauugugcauugaagcuaaaauaucaaacaccaccaccgauucaagauguccaacacaaggagaggcuacacugguggaagaacaagacgcgaacuuugugugucgacgaacguuuguggacagaggcugggguaauggcugcggacuauuuggaaaaggaagccuacugacgugugcuaaguucaagugugugacaaaacuggaaggaaagauaguucaauaugaaaacuuaaaauauucagugauagucacuguccacacaggggaccagcaccaggugggaaacgagacuacagaacauggaacaauugcaaccauaacaccccaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaagcaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauaugugaugugcacaggcucauuuaagcuagagaaggaaguggcugagacccagcauggaacuguccuagugcagguuaaauacgaaggaacagaugcaccaugcaagauccccuuuucgacccaagaugagaaaggagugacccagaaugggagauugauaacagccaaucccauaguuacugacaaagaaaaaccagucaacauugagacagaaccaccuuuuggugagagcuacaucaugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacgucugugggaaaauugguacaccagguuuuuggaaccgcauacgggguucuguucagcgguguuucuuggaccaugaaaauaggaauagggauccugcugacaugguugggauugaauucaaggagcgcgucgcuuucgaugacgugcauugcaguuggcaugguuacacuguaccuaggagucaugguucaagcggacucgggaugugugaucaacuggaagggcagagaacucaaauguggaaguggcauuuuugucacuaaugaaguccacacuuggacagagcaauacaaauuccaggcugacuccccaaaaagacugucagcagccauugggaaagcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugaucaggccacaacccauggaacacaaauacucauggaaaagcuggggaaaagccaaaaucauaggagcagacauacagaauaccaccuucaucaucgacggcccagauacuccagaaugccccgaugaccaaagagcguggaacauuugggaaguugaggacuauggguuuggaauuuucacgacaaacauauggcugaaauugcgugacuccuacacccaaaugugugaccaucggcuaaugucagcugccaucaaggacagcaaggcaguccaugcugacaugggguacuggauagaaagugaaaagaacgagaccuggaagcuagcgagagccuccuucauagaagucaagacaugcauuuggccgaaaucccacacucuauggaguaauggaguuuuggaaagugaaaugauaaucccaaagauauauggaggaccaauaucucagcacaauuacagaccaggguauuucacacaaacagcagggccauggcaccuaggcaaguuggaauuggauuuugacuugugcgaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucugacaggauggggaugggaacaacguaccuagccuugauggcuacuuucaaaaugagaccaauguucgccguuggguuauuauuucgcagacuaacauccagagagguucuucuucucacgauuggauuaagccugguggcauccguggagcuaccaaauucuuuggaggaacuaggggauggacuugcaauggguaucaugauguuaaaauuauugacugaauuucagccacaccaguuauggaccaccuuacugucucugacauuuaucaaaacaacucuuucauuggauuaugcauggaagacaauggcuaugguacugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuagccggcccacuaauagcuggaggcaugcuaauagcauguuaugucauauccggaagcucagccgauuuaucauuggagaaagcggcugagguauccugggaagaagaagcggaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaagugggagugggaguuuuccaagacggcguguuccacacaauguggcacgucaccaggggagcuguccuuauguaccaagggaagaggcuggaaccaagcugggccaguguaaaaaaggacuugaucucauauggaggagguuggagguuucaaggaucauggaacacgggagaagaagugcaggugauagcuguugaaccaggaaaaaaccccaaaaauguacagacaacgccgggcaccuucaagacucccgaaggcgaaguuggagccauagcucuagauuuuaaacccggcacaucuggaucucccauugugaacagagagggaaaaauaguaggucuuuauggaaauggaguggugacaacaaguggaaccuacgucagugccauugcccaagcuaaagcaucacaagaugggccccuaccagagauugaggacgagguguuuaagaaaagaaacuuaacaauaauggaccugcauccaggaucaggaaaaacaagaagauaucuuccagccauaguucgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacacuuuaccgauccagccagcauagcggccagaggguacaucucaacccgaguagguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacgggugauccaauugagcagaaaaaccuuugacacugaguaccagaaaacaaaaaacaaugacugggacuauguugucacaacagacauuuccgaaaugggggcaaauuucagggccgacaggguaauagacccaaggcggugcuugaaaccgguaauacuaaaagaugguccagagcgcgucauucuagcuggaccgaugccagugacuguggccagugcugcccagaggagaggaagaauuggaaggaaccaaaacaaggaaggugaucaguauguuuacaugggacagccuuuaaauaaugaugaggaucacgcccauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugacuuaauauuggaaauagggaaacuuccacaacauuugacgauaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaguguggagccccauuggauagcggccuccauuauacuagaguucuuucugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagccgccgaaaaccaccaccaugcuacaaugcuggacguagaccuacguccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauucucuugaugcggaccacaugggccuugugugaauccaucacacuggcuacaggacccuugaccacucucugggagggaucuccaggaaaauucuggaauacuacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagaucugaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuacaccaccugagaaaugugauacccuucugugugauauuggugaguccucuccgaacccaacuauagaagaaggaagaacguuacguguucuaaagaugguggaaccauggcuuagaggaaaccaauucugcauaaaaauccuaaauccuuacaugccaagugugguagaaacucuggagcaaaugcaaagaaaacauggagggaugcuagugagaaacccacucucaagaaauuccacccaugaaauguacuggguuucauguggaacaggaaacauugugucggcagugaacaugacauccagaauguuacugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugaggucaagccaucaggaucagccucaucuauggugaauggcguggugagauugcucacaaaaccaugggauguuauccccauggucacacaaauagcuaugacugauaccacgcccuucggacaacagagaguguuuaaagagaaaguugacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugcgccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguucaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcaaagaccagcaaaaaauggaaccgugauggauguuauauccagacgugaccagagaggaaguggacaagucggaacuuauggcuuaaauacuuucaccaauauggagguccaacuaauaagacaaauggagucugaaggaaucuuuuuacccugcgaauuggaaacccccaaucuagcugagagaguucuugacugguuggaaaaacauggcgccgaaaggcugaaaagaauggcaauuaguggagaugauuguguggugaaaccaauugaugacagguucgcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuuguggguagggcuagaguaucacaaggcgccggauggagccugagagaaacugcuugccuaggcaagucauacgcacaaauguggcagcugauguacuuccacaggagagaccugagacuagcggccaaugcuaucuguucagccguuccaguugauugggucccaaccagccgcacaaccuggucaauccaugcccaccaccaauggaugacgacagaagacauguuaucaguguggaauaggguuuggauagaggaaaacccauggauggaggacaaaacucauguauccaguugggaagaaguuccauaccuagggaaaagggaagaucaaugguguggaucucugauaggcuugacagcgagggccaccugggccaccaacauacaaguagccauaaaccaagugagaaggcucaucgggaaugagaauuaccuagauuacaugacaucaaugaagagauucaagaaugagagugaucccgaaggggcacucugguaa

SEQ ID NO: 5588 - RNA, 9879 nt, Artificial Sequence
  derived and/or modified CDS sequence (wt) from DENV-1__FJ410186__SS-prME
uccgugaccaugcuccucaugcugcugcccacagcccuggcuuuccauuugaccacacgagggggagagccacacaugauaguuaguaagcaagaaagaggaaagucacucuuguucaagaccucugcaggugucaauaugugcacucucauugcgauggauuugggagaguuaugugaggacacaaugaccuacaaaugcccccggaucacugagguggaaccagaugacguugacugcuggugcaaugccacagacacaugggugaccuaugggacguguucucaaaccggcgaacaccgacgagacaaacguuccguggcauuggccccacacgugggacuuggucuagaaacaagaaccgaaacauggauguccucugaaggcgccuggaaacaaauacaaaaaguggagacuugggcuuugagacacccaggauucacggugauagcuuuuuuuuuagcacaugccauaggaacauccaucacucagaaagggaucauuuucauucugcugaugcugguaacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaauugugcauugaagcuaaaauaucaaacaccaccaccgauucaagauguccaacacaaggagaggcuacacugguggaagaacaagacgcgaacuuugugugucgacgaacguucguggacagaggcugggguaauggcugcggacuauuuggaaaaggaagccuacugacgugugccaaguucaagugugugacaaaacuggaaggaaagauaguucaauaugaaaacuuaaaauauucagugauagucacuguccacacaggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcucguccacaagcaaugguuucuagacuuaccacugccuuggacuucgggggcuucaacaucccaagagacuuggaacagacaagauuugcuggucacauucaagacagcucaugcaaagaagcaggaaguagucgugcugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauaugugaugugcacaggcucauucaagcuggagaaggaaguggcugagacccagcauggaacuguccuagugcagguuaaauacgaaggaacagaugcgccaugcaagauccccuuuucaacccaagaugagaaaggagugacccagaaugggagauugauaacagccaaucccauaguuacugacaaagaaaaaccagucaacauugagacagaaccaccuuuuggugagaguuacaucauaguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacgucugugggaaaauugguacaccagguuuuuggaacugcauacgggguucuguucagcgguguuucuuggaccaugaaaauaggaauagggauccugcugacaugguugggauugaauucaaggagcgcgucgcuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagaacaauacaaauuccaggcugacuccccaaaaagacugucagcagccauugggaaggcaugggaggaaggcguguguggaauucgaucagccacgcgucuugagaacaucauguggaagcaaauuucaaaugaauugaaccacauuuuacuugaaaaugacaugaaauucacagugguuguaggagaugcuaauggaauuuuggcccaaggaaaaaaaaugaucaggccacaacccauggaacacaaauacucauggaaaagcuggggaaaagccaaaaucauaggagcagacauacagaacaccaccuucaucaucgacggcccagauacuccagaaugccccgaugaccaaagggcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgagaccuggaagcuagcgagagccuccuucauagaagucaagacaugcauuuggccgaaaucccacacucuauggaguaauggaguuuuggaaagugaaaugauaaucccaaagauauauggaggaccaacaucucagcacaauuacagaccaggguacuucacacaaacagcagggccauggcaccuaggcaaguuggaauuggauuuugacuugugugaagguaccacagucguuguggaugaacauuguggaaaucgagguccaucucucagaacaacaacagucacaggaaagauaauccaugaaugguguugcagauccugcacguuaccccccuuacgcuucagaggagaagacggauguugguauggcauggaaaucagaccaguuaaggagaaggaggagaaucuaguuaggucaauggucucugcagggucaggagaaguggacaguuuuucauugggaauauugugcguaucaauaaugauugaagaagugaugagauccagauggaguagaaagaugcugaugacuggaacacuggcuguuuuccuccuucuuauaaugggacaacugacauggaaugaucuaauuagguuaugcaucaugguuggagccaaugcuucugauaggauggggaugggaacaacguaccuagccuugauggcuacuuucaaaaugagaccaauguucgcugucggguuauuauuucgcagacuaacauccagagaaguucuucuucucacgauuggauuaagccugguggcauccguggagcuaccaaauucuuuggaggagcugggggauggacuugcaauggguaucaugaugcuaaaauuauugacugaauuucagccacaccaguuauggaccaccuuacugucucugacauuuaucaaaacaacucuuucauuggauuaugcauggaagacaauggcuaugguacugucaaucguaucucucuuucccuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaaucauggcuauuggaauagucagcauucuacuaaguucacuccucaaaaaugaugugccguuagccggcccacuaauagcuggaggcaugcuaauagcauguuaugucauauccggaagcucagccgauuuaucauuggagaaagcggcugagguauccugggaagaagaagcagaacacucugguaccucacauaacauauuaguagagguccaagaugauggaacuaugaaaauaaaagaugaagagagggaugacacacucaccauacuccucaaagcaacccugcuggcagucucaggaguguacccaaugucaauaccagcaacucuuuuugugugguauuuuuggcagaaaaagaaacagagaucaggaguguuaugggacacacccagcccuccggaaguagaaagagcaguucuugaugauggcaucuauagaauuuugcaaagaggacuguugggcaggucccaagugggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuccaaggacuauggaacacgggagaagaagugcaggugauagcuguugaaccaggaaaaaacccuaaaaauguacagacaacgccgggcaccuucaagacucccgaaggcgaaguuggagccauagcucuagauuuuaaacccggcacaucuggaucccccauugugaacagagagggaaaaauaguaggucuuuauggaaauggaguggugacaacaaguggaaccuacgucagugccauugcccaagcuaaagcaucacaagaagggccccuaccagagauugaggacgagguguuuaaaaaaagaaacuuaacaauaauggaccugcauccaggaucaggaaaaacaagaagauaucuuccagccauaguccgugaggccauaaaaaggaaacugcgcacguuaaucuuggcucccacaagaguugucgccucugaaauggcagaggcucucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcagccagaggguacaucucaacccgaguggguaugggugaagcagcugcgaucuuuaugacagccacucccccaggaucgguggaggccuuuccacagagcaaugcaguuauccaagaugaggaaagagauauuccugagagaucauggaacucaggcuacgacuggaucacugauuuuccagguaaaacagucugguuuguuccaagcauuaaaucaggaaaugacauugccaacuguuuaagaaagaacggaaaacgggugauccaauugagcagaaaaaccuuugacacugaguaccagaaaacaaaaaacaaugacugggacuauguugucacaacagacauuuccgaaaugggggcaaauuucagggccgacaggguaauagacccaaggcggugcuugaaaccgguaauacuaaaagaugguccagagcgcgucauucuagcuggaccgaugccagugacuguggccagugcugcccagaggagaggaagaauuggaaggaaccaaaacaaggaaggugaucaguacguuuacaugggacagccuuuaaacaaugaugaggaucacgcucauuggacagaagcaaaaaugcuccuugacaacauaaacacaccagaagggaucaucccagcccucuuugagccagagagagaaaagagugcagcaauagacggggaguacagacugcggggggaagcaaggaaaacguucguggagcucaugagaagaggagaucuaccaguuuggcuauccuacaaaguugccucagaagguuuccaguacuccgacagaagguggugcuuugauggggaaaggaacaaccagguguuggaggagaacauggacguggagauuuggacaaaggaaggagaaagaaagaaauugcgaccccgcugguuggaugccagaacauauucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggcaaguguggagccccacuggauagcggccuccaucauacuagaguucuuucugauggugcugcucauuccagagccagacagacaacgcacuccacaggacaaccaacuagcauauguggugauagguuuguuauucaugauacugacaguggcagccaaugagaugggauuauuggaaaccacaaagaaagaccuggggauuggccauguagccgccgaaaaucaccaccaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcggugcugauguuaguggcucauuaugccauaauuggaccaggacugcaagcaagggccacuagagaagcucaaaaaaggacagcggccggaauaaugaaaaauccaaccguagacgggauuguugcaauagacuuggauccugugguuuaugacgcaaaauuugaaaaacagcuaggccaaauaauguuacugauacuuuguacaucacagauucucuugaugcggaccacaugggccuugugugaauccaucacacuggcuacuggacccuugaccacucucugggagggaucuccagggaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaaggcaguuaaaccaacugagcaagucagaauucaacaccuacaaaaggagugggauuauggagguggacagaucugaagccaaagagggauugaaaagaggagaaacaaccaaacaugcagugucgagaggaacagccaaacugaggugguuuguggagaggaaccuugugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuacaccaccugagaaaugugauacccugcugugcgauauuggugaguccucuccgaauccaacuauagaagaaggaagaacguuacguguucuaaagaugguggaaccauggcuuagaggaaaccaauucugcauaaaaauccuaaauccuuacaugccaagugugguagaaacucuggagcaaaugcaaaggaaacauggagggaugcuagugagaaacccacucucaagaaauuccacccaugaaauguacuggguuucauguggaacaggaaacauugugucggcagugaacaugacauccagaauguuacugaaucgauucacaauggcucauaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaagacaauccauacaaaacaugggccuaucauggaucauaugaggucaagccaucaggaucagccucaucuauggugaauggcguggugagauugcucacaaaaccaugggauguuauccccauggucacacaaauagcuaugacugacaccacacccuucggacaacagagaguguuuaaagagaaaguugacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcgcagagagagggagcuucauaaacagggaaaaugcgccacgugugucuacaacaugauggggaagagagagaaaaaauuaggagaguuuggaaaggcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugauacagccggaugggacacaagaauaacagaggaugaccuucagaaugaggcuaaaaucacugacaucauggagccugaacaugcucuauuggcuacgucaauuuuuaagcuuaccuaccaaaacaagguggugagggugcaaagaccagcaaaaaauggaacugugauggauguuauauccagacgugaccagagaggaaguggacaggucggaacuuauggcuuaaauacuuucaccaauauggagguccaacuaauaagacaaauggagucugaaggaaucuuuuugcccagcgaacuggaaacccccaauuuagcugagagaguccuugacugguuggaaaaacauggcgccgagaggcugaaaagaauggcaauuaguggagaugauuguguggugaaaccaguugaugacagguucgcaacagccuuaauagcucugaaugacaugggaaaaguaagaaaagacauaccgcagugggaacccucaaaaggauggaaugacuggcagcaagugccuuucugcucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauacgcacaaauguggcagcugauguacuuccacaggagagaccugagacuggcggcuaaugcuaucuguucagccgacccaguugauugggucccaaccagccgcacaacuuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucucugauaggcuugacagcgagggccaccugggccaccaacauacaaguagccauaaaccaagugagaaggcucaucgggaaugagaauuaucuagauuacaugauaucaaugaagagauucaagaaugagagugaucccgaaggggcacucugguaa

SEQ ID NO: 5589 - RNA, 9879 nt, Artificial Sequence
  derived and/or modified CDS sequence (wt) from DENV-1__FJ410187__SS-prME
ucugugaccaugcuccucaugcugcugcccacagcccuggcguuccauuugaccacacgagggggagagccacacaugauaguuaguaagcaggaaagaggaaagucacuguuguuuaagaccucugcaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacauguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgaugugugggaauaggcaacagggacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacauagauacucauggaaaagcuggggaaaagccaaaaucauaggagcagacauacagaauagcaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaggcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgaggcccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuaugcguaucaauaaugauugaagaagugaugagauccagauggaguagaaagaugcugaugacuggaacauuggcuguuuuccuccuucuuauaaugggacaacugacauggaaugaccugauuagguuaugcaucaugguuggagcuaaugcuucagacaggauggggaugggaacaacguaccuggccuugauggcuacuuucaaaaugagaccaauguucgcuguugggcuacuauuucgcagacuaacauccagagaaguucuucuucucacgauuggauuaagccugguggcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuggccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaagugggagugggaguuuuccaggacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagccguugaaccaggaaaaaauccuaaaaauguacagacaacgccggguaccuucaagacucccgaaggcgaaguuggagccauagcccuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggaggagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaaguaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaagaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugccucagaagguuuccaguacuccgacagaagguggugcuuugacggggaaaggaacaaccagguguuggaggagaacauggacguggagaucuggacaaaggaaggagaaaggaagaaauugcgaccccgcugguuggaugccagaacauacucugauccacuggcccuucgugaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggccauguagccgccgaaaaccaacaccaugccacgaugcuggacguagaccuacgcccagcuucagccuggacccucuaugcaguagccacaacaguuaucacucccaugaugagacacacaauugaaaacacaacagcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggcccugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauucuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggcuaaaaucacugacaucauggagccugaacacgcucuauuagcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuugacugguuggaaaaacauggcacugaaaggcugaaaagaauggcaauuagcggagaugauuguguggugaaaccaguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacuggguuccaaccagccgcacaaccuggucaauccaugcucaccaucaauggaugacaacagaagauauguuaucaguguggaauaggguuuggauagaggaaaacccauggauggaggauaaaacucauguauccagcugggaagaagucccauacuuagggaaaagggaagaucaaugguguggaucccugauaggcuugacagcgagggccacuugggccacuaacauacaaguagccauaaaccaagugagaaggcucaucggaaaugagaauuaucuagauuacaugacaucaaugaagagauucaagaaugagagugaucccgaaggggcacucugguaa

SEQ ID NO: 5590 - RNA, 9879 nt, Artificial Sequence
  derived and/or modified CDS sequence (wt) from DENV-1__FJ478457__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaacaugugcacucucauugcgauggauuugggagaguuaugugaggacacaaugaccuacaaaugccccaggaucacugaggcggaaccagaugacguugacugcuggugcaaugccacagacacaugggugaccuaugggacguguucucaaaccggugaacaccgacgagacaaacguuccguggcacuggccccacacguaggacuuggucuagaaacaagaaccgaaacauggauguccucugaaggcgccuggaaacaaauacaaaaaguggagacuugggcuuugagacacccaggauucacggugauagcccuuuuucuagcacaugccauaggaacauccaucacucagaaagggaucauuuucauuuugcugaugcugguaacaccaucaauggccaugcgaugcgugggaauaggcaacagagacuucguugaaggacugucaggagcaacguggguggacgugguauuggagcauggaagcugugucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgacgaacguuuguggauagaggcugggguaauggcugcggacuauuuggaaaaggaagccuacugacgugugcuaaguucaagugugugacaaaacuggaaggaaagauaguucaacaugaaaauuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacacugcguugacuggagcgacagaaauccagacgucaggaacgacaacaaucuuugcagggcaucugaaaugcagacuaaaaauggacaaacugacuuuaaaagggaugucauaugugaugugcacaggcucauuuaagcuagagaaggaaguggcugagacccagcauggaacuguccuagugcagguuaaauacgaaggaacagaugcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauacugggagacaccgcaugggacuucggcucuauaggaggaauguucacgucugugggaaaauugguacaccagguuuuuggaaccgcauaugggguuuuguucagcgguguuucuuggaccaugaaaauaggaauagggauucugcugacaugguugggauuaaauucaaggagcacgucacuuucgaugacgugcauugcaguuggcaugguuacacuguacuuaggagucaugguucaagcggacucgggauguguaaucaacuggaagggcagagaacucaaauguggaaguggcauuuucgucacuaaugaaguccacacuuggacagagcaauacaaauuccaggcugauuccccaaagagacuuucagcagccauugggaaggcaugggaggagggcguguguggaauucggucagccacgcgucuugagaacaucauguggaagcaaauaucaaaugaauugaaccacauucuacuugagaaugacaugaaauucacagugguuguaggagaugcuaguggaauuuuggcccaaggaaaaaaaaugaucaggccacaacccauggaacacaaauacucauggaaaagcuggggaaaagccaaaaucauaggagcagacauacagaacaccacuuuuaucaucgacggcccagauacuccagaaugcuccgaugaccaaagagcauggaacauuugggaagucgaggacuauggguuuggaauuuucacgacaaacauauggcugaaauugcgugacuccuacacccaaaugugugaccaccgguuaaugucagcugccaucaaggacagcaaggcaguccaugcugacaugggguacuggauagaaagugaaaagaacgagaccuggaagcuagcgagagcuuccuucauagaagucaagacaugcaucuggccgaaaucucacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugaccugugugaaggcaccacaguuauuguggaugaacauuguggaaaucgagguccaucucucagaaccacaacagucacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauugggaauacuaugcguaucaauaaugauugaagaagugaugagauccagauggaguagaaagaugcugaugacuggaacacuggcuguuuuucuccuucuuauaaugggacaacugacauggaaugaucugauuaggcuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuccuucucacgauuggauuaagccugguggcauccguggagcuaccaaauucuuuggaggagcuaggggauggacuugcaauggguaucaugauguuaaaauuauugacugaauuucagccacaccagcuauggaccaccuuacugucucugacguuuaucaaaacaacucuuucauuggauuaugcauggaagacaauggcuauggcacugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccguuagccggcccacuaauagcuggaggcauguuaauagcauguuaugucauauccggaagcucagccgauuuaucauuggagaaagcggcugagguauccugggaagaagaagcagaacacucugguaccucacacaacauguuaguagagguccaagaugauggaacuaugaaaauaaaagaugaagagagggaugacacacucaccauacuccucaaagcaacucugcuggcagucucaggaguguacccaaugucaauaccagcaacucuuuuuguuugguauuuuuggcagaaaaagaaacagagaucaggaguguuaugggacacacccagcccuccagaaguggaaagagcaguucuugaugauggcaucuauagaaucuugcaaagaggacuguugggcaggucccaagugggagugggaguuuuccaagacggcguguuccacacaauguggcacgucaccaggggagcuguccuuauguaccaagggaagaggcuggaaccaagcugggccaguguaaaaaaggacuugaucucauauggaggagguuggagguuucaaggaucauggaacacuggagaagaagugcaggugauagcuguugaaccaggaaaaaaccccaaaaauguacagacaacgccggguaccuucaagacucccgaaggcgaaguuggggccauagcucuagauuuuaagcccggcacaucuggaucucccaucgugaacagagagggaaaaauaguaggucucuauggaaauggaguggugacaacaaguggaaccuacgucagugccauugcccaagcuaaagcaucacaagaagggccucuaccagagauugaggaugagguguuuaggaaaagaaacuuaacaauaauggaccugcauccaggaucaggaaaaacaagaagauaucuuccagccauaguccgugaggccauaaaaaggaaacugcgcacguuaaucuuggcccccacaagaguugucgccucugaaauggcagaggcacucaagggaaugccaauaagauaucagacaacagcagugaagagugaacacacaggaagggagauaguugaccucaugugccacgccacuuuuaccaugcgucucuuaucuccagugagaguuccuaauuacaacaugauuaucauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccaggcaaaacagucugguuugucccaagcaucaaaucaggaaaugacauugccaacuguuuaagaaagaacggaaaacgggugauccaauugagcagaaaaaccuuugacacugaguaccagaaaacaaaaaacaaugacugggauuauguugucacaacagacauuuccgaaaugggggcaaauuuccgggccgauaggguaauagacccaaggcggugcuugaaaccgguaauacuaaaagaugguccagagcgcgucauucuagccggaccgaugccagugacuguggccagugcugcucagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuauaaaguugccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcccuggauaacuuggucauguugcacaauuccgaacaaggaggaaaagccuauagacaugcuauggaggaacuaccagacaccauagaaacauugaugcucuuagcuuugauagcugugcugacugguggagugacgcuguucuuccuaucaggaaaaggucuagggaaaacauccauuggccugcucugugugauggccucaagcgcacuguuauggauggccaguguggagccccauuggauagcggccuccaucauacuagaguucuuucugauggugcugcucauuccagagccagacagacagcgcacuccacaggacaaccagcuagcauauguggugauagguuuguuauucaugauacugacaguggcagccaaugagaugggauuauuggaaacuacaaagaaagaccuggggauuggccauguagccgccgaaaaccaccaccaugcuacaaugcuggacguagaccuacguccagcuucagccuggacccucuaugcaguagccacaacaguuaucacucccaugaugagacacacaauugaaaauacaacggcaaacauuucccugacagccauugcaaaucaggcagcuauauugaugggacuugauaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaagaacagcggccggaauaaugaaaaauccaaccguagaugggauuguugcaauagacuuggauccugugguuuaugaugcaaaauuugaaaaacagcuaggccaaauaauguuacugauacuuugcacaucacagauucucuugaugcggaccacaugggccuugugugaauccaucacacuggcuacuggacccuugaccacacucugggagggauccccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaagacagcuaaaccaacugagcaagucagaauucaacaccuacaaaaggagugggauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguugugggagagguggcuggucauauuauugugcuggguugaagaaggucacugaagugaagggauacacaaaaggaggaccuggacaugaggaacccaucccaauggcgaccuauggauggaaccuaguaaagcuacacucuggaaaagauguauuuuuuacaccaccugagaaaugugauacccuucugugugauauuggugaguccucuccgaauccaacuauagaagaaggaagaacguuacguguucuaaagaugguggaaccauggcucagaggaaaccaauucuguauaaaaauccuaaauccuuacaugccaagugugguagaaacucuggagcaaaugcaaagaaaacauggagggaugcuagugaggaacccacucucaagaaauuccacccaugaaauguacuggguuucauguggaacaggaaacauugugucggcagugaacaugacauccagaauguuacugaaucgauucacaauggcucauaggaagccaacauaugaaagagacguugacuuaggcgcuggaacaagacauguggcaguggaaccagagguagccaaccuagauaucauuggccagaggauagagaacauaaaaaaugaacacaagucaacauggcauuaugaugaagacaauccauacaaaacaugggccuaucauggaucauaugaggucaagccaucaggaucagccucaucuauggugaauggcgugguaagauugcucacaaaaccaugggauguuauccccauggucacacaaauagcuaugacugauacuacacccuucggacaacagagaguguuuaaagagaaaguugacacgcgcacaccaagagcaaaacgaggcacagcacaaguuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaaaguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuuuuagaguucgaggcccuugguuucaugaaugaagaucacugguucaguagagagaauucacucaguggaguggaaggagaaggacugcacaaacuuggauauauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcagagaccagcaaaaaauggaaccgugauggaugucauauccagacgugaccagagaggaaguggacaggucggaacuuauggcuuaaauacuuucaccaacauggagguccaacuaauaagacagauggagucugaaggaaucuuuuuacccagcgaauuggaaaccccaaaucuagcugagagaguucuugacugguuggaaaaacauggcaccgaaaggcugaaaagaauggcaauuagcggagaugauuguguggugaaaccaauugaugacagguucgcaacagccuuaauagcucugaaugacauggggaaaguaagaaaagacauaccgcagugggaaccuucaaaaggauggaaugaauggcagcaagugccuuucuguucacaccauuuccaccagcugaucaugaaggaugggagggaaauaguggugccaugccgcaaccaagaugaacuugugggcagggccagaguaucacaaggcgccggauggagccugagagaaacugcuugccuaggcaagucauacgcacaaauguggcagcugauguacuuccacaggagagaccugagacuagcggcuaaugccaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaccaaugguguggaucccugauaggcuugacagcgagggccaccugggccaccaacauacaaguagccauaaaccaagugagaaggcucaucgggaaugagaauuaucuagauuacaugacaucaaugaagagauuuaagaaugagagugaucccgaaggggcacucugguaa

SEQ ID NO: 5591 - RNA, 9879 nt, Artificial Sequence
  derived and/or modified CDS sequence (wt) from DENV-1__FJ410188__SS-prME
uccgugaccaugcuccucaugcugcugcccacaguccuggcguuccauuugaccacacgagggggagagccacacaugauaguuaguaagcaggaaagaggaaagucacucuuguuuaagaccucugcaggugucaacaugugcacucucauugcgauggauuugggagaguuaugugaggacacaaugaccuacaaaugccccaggaucacugaggcggaaccagaugacguugacugcuggugcaaugccacagacacaugggugaccuaugggacguguucucaaaccggugaacaccgacgagacaaacguuccguggcacuggccccacacguaggacuuggucuagaaacaagaacugaaacauggauguccucugaaggcgccuggaaacaaauacaaaaaguggagacuugggcuuugagacauccaggauucacggugauagcucuuuuucuagcacaugccauaggaacauccaucacucagaaagggaucauuuucauuuugcugaugcugguaacaccaucaauggccaugcgaugcgugggaauaggcaacagagacuucguugaaggacugucaggagcaacguggguggacgugguauuggagcauggaagcugugucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgacgaacguuuguggauagaggcugggguaauggcugcggacuauuuggaaaaggaagccuacugacgugugcuaaguucaagugugugacaaaacuggaaggaaagauaguucaacaugaaaauuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagacuuggaacagacaagauuugcuggucacauucaagacagcucaugcaaagaaacaggaaguagucguacugggaucacaagaaggagcaaugcacacugcguugacuggagcgacagaaauccagacgucaggaacgacaacaaucuuugcagggcaucugaaaugcagacuaaaaauggacaaacugacuuuaaaagggaugucauaugugaugugcacaggcucauuuaagcuagagaaggaaguggcugagacccagcauggaacuguccuagugcagguuaaauacgaaggaacagaugcgccaugcaagauccccuuuucgacccaagaugagaaaggagugacccagaaugggagauugauaacagccaaucccauagucacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauacugggagacaccgcaugggacuucggcucuauaggaggaauguucacgucugugggaaaauugguacaccagguuuuuggaaccgcauaugggguuuuguucagcgguguuucuuggaccaugaaaauaggaauagggauucugcugacaugguugggauuaaauucaaggagcacgucacuuucgaugacgugcauugcaguuggcaugguuacacuguacuuaggagucaugguucaagcggacucgggauguguaaucaacuggaagggcagagaacucaaauguggaaguggcauuuucgucacuaaugaaguccacacuuggacagagcaauacaaauuccaggcugauuccccaaagagacuuucagcagccauugggaaggcaugggaggagggcguguguggaauucgaucagccacgcgucuugagaacaucauguggaagcaaauaucaaaugaauugaaccacauucuacuugagaaugacaugaaauucacagugguuguaggagaugcuaguggaauuuuggcccaaggaaaaaaaaugaucaggccacaacccauggaacacaaauacucauggaaaagcuggggaaaagccaaaaucauaggagcagacauacagaacaccacuuuuaucaucgacggcccagauacuccagaaugcuccgaugaccaaagagcauggaacauuugggaagucgaggacuauggguuuggaauuuucacgacaaacauauggcugaaauugcgugacuccuacacccaaaugugugaccaccgguuaaugucagcugccaucaaggacagcaaggcaguccaugcugacaugggguacuggauagaaagugaaaagaacgagaccuggaagcuagcgagagcuuccuucauagaagucaagacaugcaucuggccgaaaucucacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugaccugugugaaggcaccacaguuauuguggaugaacauuguggaaaucgagguccaucucucagaaccacaacagucacaggaaagauaauccaugaaugguguugcagauccugcacguuaccccccuuacgcuucagaggagaagacggauguugguauggcauggaaaucagaccaguuaaggagaaggaggagaaccuaguuaggucaauggucucugcagggucaggagaaguggacaguuuuucauugggaauacuaugcguaucaauaaugauugaagaagugaugagauccagauggaguagaaagaugcugaugacuggaacacuggcuguuuuucuccuucuuauaaugggacaacugacauggaaugaucugauuaggcuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccagcuauggaccaccuuacugucucugacguuuaucaaaacaacucuuucauuggauuaugcauggaagacaauggcuauggcacugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccguuagccggcccacuaauagcuggaggcauguuaauagcauguuaugucauauccggaagcucagccgauuuaucauuggagaaagcggcugagguauccugggaagaagaagcagaacacucugguaccucacacaacauguuaguagagguccaagaugauggaacuaugaaaauaaaagaugaagagagggaugacacacucaccauacuccucaaagcaacucugcuggcagucucaggaguguacccaaugucaauaccagcaacucuuuuugugugguauuuuuggcagaaaaagaaacagagaucaggaguguuaugggacacacccagcccuccagaaguggaaagagcaguucuugaugauggcaucuauagaaucuugcaaagaggacuguugggcaggucccaagugggagugggaguuuuccaagacggcguguuccacacaauguggcacgucaccaggggagcuguccuuauguaccaagggaagaggcuggaaccaagcugggccaguguaaaaaaggacuugaucucauauggaggagguuggagguuucaaggaucauggaacacuggagaagaagugcaggugauagcuguugaaccaggaaaaaaccccaaaaauguacagacaacgccggguaccuucaagacucccgaaggcgaaguuggagccauagcucuagauuuuaagcccggcacaucuggaucucccaucgugaacagagagggaaaaauaguaggucucuauggaaauggaguggugacaacaaguggaaccuacgucagugccauugcccaagcuaaagcaucacaagaagggccucuaccagagauugaggaugagguguuuaggaaaagaaacuuaacaauaauggaccugcauccaggaucaggaaaaacaagaagauaucuuccagccauaguccgugaggccauaaaaaggaaacugcgcacguuaaucuuggcccccacaagaguugucgccucugaaauggcagaggcacucaagggaaugccaauaagauaucagacaacagcagugaagagugaacacacaggaagggagauaguugaccucaugugccacgccacuuuuaccaugcgucucuuaucuccagugagaguuccuaauuacaacaugauuaucauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccaggcaaaacagucugguuugucccaagcaucaaaucaggaaaugacauugccaacuguuuaagaaagaacggaaaacgggugauccaauugagcagaaaaaccuuugacacugaguaccagaaaacaaaaaacaaugacugggauuauguugucacaacagacauuuccgaaaugggagcaaauuuccgggccgauaggguaauagacccaaggcggugcuugaaaccgguaauacuaaaagaugguccagagcgcgucauucuagccggaccgaugccagugacuguggccagugcugcucagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagcgcagcaauagacggggaguacagacugcggggagaagcaaggaaaacguucguggagcucaugagaagaggagaucuaccaguuuggcuauccuacaaaguugccucagaagguuuucaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguucaaagaguuugcagcaggaagaagaagugucucaggugaccuaaucuuggaaauagggaaacuuccacaacauuugacgcuaagagcccagaaugcuuuggauaacuuggucauguugcacaauuccgaacaaggaggaaaagccuauagacaugcuauggaggaacuaccagacaccauagaaacauugaugcucuuagcuuugauagcugugcugacugguggagugacgcuguucuuccuaucaggaaaaggucuagggaaaacauccauuggccugcucugugugauggccucaagcgcacuguuauggauggccaguguggagccccauuggauagcggccuccaucauacuagaguucuuucugauggugcugcucauuccagagccagacagacagcgcacuccacaggacaaccagcuagcauauguagugauagguuuguuauucaugauacugacaguggcagccaaugagaugggauuauuggaaacuacaaagaaagaccuggggauuggccauguagccgccgaaaaccaccaccaugcuacaaugcuggacguagaccuacguccagcuucagccuggacccucuaugcgguagccacaacaguuaucacucccaugaugagacacacaauugaaaauacaacagcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcggugcugauguuaguggcucauuaugccauaauuggaccaggacugcaagcaaaggccacuagagaagcucaaaaaaggacagcggccggaauaaugaaaaauccaaccguagaugggauuguugcaauagauuuggauccugugguuuaugaugcaaaauuugaaaaacagcuaggccaaauaauguuacugauacuuugcacaucacagauucucuugaugcggaccacaugggccuugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucauuaaugaaaucuuuaggaggagguaggagagguacgggagcucaaggggaaacacugggagagaaauggaaaagacagcuaaaccaacugagcaagucagaauucaacaccuacaaaaggagugggauuauggagguggacagauccgaagccaaagagggauugaaaagaggagaaacaaccaaacaugcagugucgagaggaacagccaaacugaggugguuuguggagaggaaccucgugaaaccagaagggaaagucauagaucucgguugugggagagguggcuggucauauuauugugcugggcugaagaaggucacugaagugaagggauacacaaaaggaggaccuggacaugaggaacccaucccaauggcgaccuauggauggaaccuaguaaagcuacacucuggaaaagauguauuuuuuacaccaccugagaaaugugauacccuucugugugauauuggugaguccucuccgaauccaacuauagaagaaggaagaacguuacguguucuaaagaugguggaaccauggcucagaggaaaccaauucuguauaaaaauccuaaauccuuacaugccaagugugguagaaacucuggagcaaaugcaaagaaaacauggagggaugcuagugaggaacccacucucaagaaauuccacccaugaaauguacuggguuucauguggaacaggaaacauugugucggcagugaacaugacauccagaauguuacugaaucgauucacaauggcucauaggaagccaacauaugaaagagacguugacuuaggcgcuggaacaagacauguggcaguggaaccagagguagccaaccuagauaucauuggccagaggauagagaacauaaaaaaugaacacaagucaacauggcauuaugaugaagacaauccauacaaaacaugggccuaucauggaucauaugaggucaagccaucaggaucagccucaucuauggugaauggcgugguaagauugcucacaaaaccaugggauguuauccccauggucacacaaauagcuaugacugauacuacacccuucggacaacagagaguguuuaaagagaaaguugacacgcgcacaccaagagcaaaacgaggcacagcacaaguuauggaagugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaaaguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuuuuagaguucgaggcccuugguuucaugaaugaagaucacugguucaguagagagaauucacucaguggaguggaaggagaaggacugcacaaacuuggauauauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugaccuaccaaaacaagguggugagggugcagagaccagcaaaaaauggaaccgugauggaugucauauccagacgugaccagagaggaaguggacaggucggaacuuauggcuuaaauacuuucaccaacauggagguccaacuaauaagacagauggagucugaaggaaucuuuuuacccagcgaauuggaaaccccaaaucuagcugagagaguucuugacugguuggaaaaacauggcaccgaaaggcugaaaagaauggcaauuagcggagaugauuguguggugaaaccaauugaugacagguucgcaacagccuuaauagcucugaaugacauggggaaaguaagaaaagacauaccgcagugggaaccuucaaaaggauggaaugaauggcagcaagugccuuucuguucacaccauuuccaccagcugaucaugaaggaugggagggaaauaguggugccaugccgcaaccaagaugaacuugugggcagggccagaguaucacaaggcgccggauggagccugagagaaacugcuugccuaggcaagucauacgcacaaauguggcagcugauguacuuccacaggagagaccugagacuagcggcuaaugccaucuguucagccgucccaguugauugggucccaaccagccgcacaaccuggucaauccaugcccaccaccaauggaugacaacagaagacauguuaucaguguggaauagggucuggauagaggaaaacccauggauggaggacaaaacucauguauccaguugggaagaaguuccauaccuagggaaaagggaagaucaaugguguggaucucugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5592 - RNA, 9879 nt, Artificial Sequence
  derived and/or modified CDS sequence (wt) from DENV-1__FJ478458__SS-prME
ucugugaccaugcuccucaugcugcugcccacagcccuggcguuccauuugaccacacgagggggagagccacacaugauaguuaguaagcaggaaagaggaaagucacuguuguuuaagaccucugcaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacauguucucaaaccggcgaacaccgacgagacaaacguuccguggcacuggccccacacgugggacuuggucuagaaacaagaacggaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgaugugugggaauaggcaacagagacuucguugaaggacugucaggagcaacguggguggacgugguauuggagcauggaagcugcgucaccaccauggcaaaagauaaaccaacauuggacauugaacucuugaagacggaggucacaaacccugccaucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaaggaaagauaguucaauaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacauagauacucauggaaaagcuggggaaaagccaaaaucauaggagcagacauacagaauaccaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaggcaguccaugcugacaugggguacuggauagaaagugaaaagaacgagaccuggaagcuagcgagagccuccuucauagaagucaagacauguaucuggccaaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgaggcccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuaugcguaucaauaaugauugaagaagugaugagauccagauggaguagaaagaugcugaugacuggaacauuggcuguuuuccuccuucuuauaaugggacaacugacauggaaugaccugauuagguuaugcaucaugguuggagcuaaugcuucagacaggauggggaugggaacaacguaccuggccuugauggcuacuuucaaaaugagaccaauguucgcuguugggcuacuauuucgcagacuaacauccagagaaguucuucuucucacgauuggauuaagccugguggcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucgcaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuggccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaagugggagugggaguuuuccaagacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagccguugaaccaggaaaaaaucccaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggaggagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaagcaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugccucagaagguuuccaguacuccgacagaagguggugcuuugacggggaaaggaacaaccagguguuggaggagaacauggacguggagaucuggacaaaggaaggagaaaggaagaaauuacgaccccgcugguuggaugccagaacauacucugauccacuggcccuucgugaguuuaaagaauuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggccauguagccgccgaaaaccaacaccaugccacgaugcuggacguagaccuacgcccagcuucagccuggacccucuaugcaguagccacaacaguuaucacucccaugaugagacacacaauugaaaacacaacagcaaacauuucccugacagccauugcaaaccaggcagcuauauugaugggacuugacaagggauggccaauaucgaagauggacauaggaguuccacuucucgccuuagggugcuauucccaggugaaccccuugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggcccugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaagccaacauaugaaagagacguggacuuaggcgcuggaacaagacauguggcaguggaaccggagguagccaaccuagauaucauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggcuaaaaucacugacaucauggagccugaacacgcucuauuggcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuugacugguuggaaaaacauggcacugaaaggcugaaaagaauggcaauuagcggagaugauugugucgugaaaccaguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacugggucccaaccagccgcacaaccuggucaauccaugcucaccaucaauggaugacaacagaagauauguuaucaguguggaauaggguuuggauagaggaaaacccauggauggaggauaaaacucauguauccagcugggaagaagucccauacuuagggaaaagggaagaucaaugguguggaucccugauaggcuugacagcgagggccacuugggccacuaacauacaaguagccauaaaccaagugagaaggcucaucgggaaugagaauuaucuagauuacaugacaucaaugaagagauucaagaaugagagugaucccgaaggggcacucugguaa

SEQ ID NO: 5593 - RNA, 9879 nt, Artificial Sequence
  derived and/or modified CDS sequence (wt) from DENV-1__FJ410190__SS-prME
ucugugaccaugcuccucaugcugcugcccacagcccuggcguuccauuugaccacacgagggggagagccacacaugauaguuaguaagcaggaaagaggaaagucacuguuguuuaagaccucuguaggcaucaauaugugcacucucauugcgauggauuugggagaguuaugcgaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugauagcccuuuuuuuagcacaugccauaggaacauccauuacucagaaagggaucauuuucauuuugcugaugcuaguaacaccaucaauggccaugcgaugugugggaauaggcaacagagacuucguugaaggacugucaggagcaacguggguggacgugguauuggagcauggaagcugcgucaccaccauggcaaaagauaaaccaacauuggacauugaacucuugaagacggaggucacaaacccugccgucuugcgcaaacuguguauugaagcuaaaauaucaaacaccaccaccgauucaagguguccaacacaaggagaggcuacacugguggaagaacaagacucgaacuuugugugucgacgaacguuuguggacagaggcugggguaauggcugcggacuauuuggaaaaggaagcuuacugacgugugcuaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugacugacuacggagcccucacauuggacugcucgccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaauugacuuuaaaagggaugucauauguaaugugcacaggcucauuuaagcuagagaaggaaguggcugagacccagcauggaacuguucuagugcagguuaaauacgaaggaacagaugcgccaugcaagaucccuuuuucggcccaagaugagaagggagugacccagaaugggagauugauaacagccaaccccauagucacugacaaagaaaaaccagucaacauugagacagaaccaccuuuuggugagagcuacaucgugauaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucaggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacauagauacucauggaaaagcuggggaaaagccaaaaucauaggagcagacauacagaauaccaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaaugucagcugccaucaaagacagcaaggcaguccaugcugacaugggguacuggauagaaagugaaaagaacgagaccuggaagcuagcgagagccuccuucauagaagucaagacauguaucuggccgaaaucccacacucuauggaguaauggaguuuuggaaagugaaaugauaaucccaaagauauauggaggaccaauaucucaacacaacuacagaccaggguauuucacacaaacagcagggccauggcaucuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguagacaguuuuucacuagggauacuaugcguaucaauaaugauugaagaagugaugagauccagauggaguagaaagaugcugaugacuggaacauuggcuguuuuccuccuucuuauaaugggacaacugacauggaaugaucugauuagguuaugcaucaugguuggagcuaaugcuucagacaggauggggaugggaacaacguaccuggccuugauggcuacuuucaaaaugagaccaauguucgcuguugggcuauuauuucgcagacuaacauccagagaaguucuucuucucacgauuggauuaagccuaguggcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuagccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaaguaggagugggagucuuccaagacggcguguuccacacaauguggcacgucaccaggggagcuguccuuauguaccaagggaagagguuagaaccaagcugggccagugucaaaaaggacuugaucucauauggaggagguuggagauuucaaggaucauggaacacgggagaagaggugcaggugauagcuguugaaccaggaaaaaaucccaaaaauguacagacaacgccggguaccuucaagacucccgaaggcgaaguuggagccauagcucuagauuuuaaacccggcacaucuggaucucccaucgugaacagagaggaaaaaauaguaggucuuuauggaaauggaguggugacaacaaguggaaccuacgucagugccauugcccaagcuaaaacaucacaagaagggccucuaccagagauugaggacgagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaagcaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaguugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacaccagaagggaucauuccagcccucuuugagccagagagagaaaagagugcagcaauagauggggaguacagacugcggggagaagcaaggaaaacguucguggagcucaugagaagaggagaucuaccaguuuggcuauccuacaaaguugccucagaagguuuccaguacuccgacagaaggugguguuuugauggggaaaggaacaaccaaguguuggaggagaacauggacguggagaucuggacaaaggaaggagaaagaaagaaauugcgaccccgcugguuggaugccagaacauacucugauccacuggcccuucgugaguucaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggacuauuggaaaccacaaagaaagaccuggggauuggccauguagccgccgaaaaccaacaacaugccacgaugcuggacguagaccuacgcccagcuucagccuggacccucuaugcaguagccacaacaguuaucacuccuaugaugagacacacaauugaaaacacaacggcaaacauuucccugacagccauugcaaaccaggcagccauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggccuugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguacuggguuucauguggaacaggaaacauugugucggcagugaacaugacauccagaauguuacuaaaucgauucacaauggcucacaggaagccaacauaugaaagagacguggacuuaggcgcuggaacaagacauguggcaguggaaccugagguagccaaccuagauaucauuggccagaggauagagaauauaaaaaaugaacacaagucaacauggcauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguggacacgcgcacaccaagagcaaaacgaggcacagcacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaauauguaugcagaugacacagccggaugggacacaagaauaacagaggaugaucuucagaaugaggccaaaaucacugacaucauggagccugaacacgcucuauuggcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuugacuggcuggaaaaacauggcaccgaaaggcugaaaagaauggcaauuagcggagaugauuguguggugaaaccgguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccguaaccaagaugaacuugugggcagggcuagaguaucacaaggcgccggauggagccugagagaaacugcuugccuaggcaagucauaugcacaaauguggcagcugauguacuuccacaggagagaccuaagauuagcggcuaaugcuaucuguucagcugucccaguugacugggucccaaccagccgcacaaccuggucaauccaugcucaccaucaauggaugacaacagaagauauguuaucaguguggaauaggguuuggauagaggaaaacccauggauggaggauaaaacucacguauccagcugggaagaagucccauacuuaggaaaaagggaagaucaaugguguggaucccugauaggcuugacagcgagggccacuugggccacuaacauacaaguagccauaaaccaagugagaaggcucaucgggaacgagaauuaucuagauuacaugacaucaaugaagagauucaagaaugagagugaucccgaaggggcacucugguaa

SEQ ID NO: 5594 - RNA, 9879 nt, Artificial Sequence
  derived and/or modified CDS sequence (wt) from DENV-1__EU482591__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcuuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguacuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacaugugccaaguucaagugugugacaaaacuagaaggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggagcgacagaaauccagacgucaggaacgacaacaauuuucgcaggacaucugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcagauaucaaaugaauugaaccacauucuacuugagaaugacaugaaauucacagugguuguaggagaugccaacggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacgcuaccccccuuacguuucagaggagaagacggauguugguauggcauggaaaucagaccagugaaggagaaggaggagaaucuaguuaggucaauggucucugcagggucaggagaaguggauaguuuuucauuaggaauacuaugcguaucaauaaugauugaagaagugaugagauccagauggaguagaaagaugcugaugacuggaacacuggcuguuuuucuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguagggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacggcuauggcacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacagcauauuaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugauaauggcaucuauagaaucuugcaaagaggacuguugggcaggucccaaguaggagugggagucuuccaagacggcguguuccacacaauguggcacgucaccagaggagcuguccuuauguaccaagggaagagacuggaaccaagcugggccagugucaaaaaggacuugaucucauauggaggagguuggagguuccaaggaucauggaacacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguauuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugccacaaugcuggacguagaccuacacccagcuucagccuggacccucuaugcaguagccacaacagucaucacucccaugaugagacacacaauugaaaauacaacggcaaacauuucccugaccgccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuauugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaauaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucaagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcgaaugcaaagaaaacauggagggaugcuagugcgaaacccacucucaagaaauuccacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacgaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggccaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccaacugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagcuauaaaccaagugagaaggcucaucgggaaugagaauuauuuagauuacaugacaucaaugaagagauucaagaaugagagugauuccgaaggagcacucugguaa

SEQ ID NO: 5595 - RNA, 9879 nt, Artificial Sequence
  derived and/or modified CDS sequence (wt) from DENV-1__EU482592__SS-prME
ucugugaccaugcuccucaugcugcugcccacagcccuggcguuccauuugacuacacgagggggagagccacacaugauaguuaguaagcaggaaagaggaaagucacuguuguuuaagaccucugcaggcaucaauaugugcacucucauugcgauggaucugggagaguuaugcgaggacacaaugaccuacaaaugcccccggaucacugaggcggaaccagaugacguugacugcuggugcaaugccacagacacaugggugaccuaugggacauguucucaaaccggcgaacaccgacgagacaaacguuccguggcacuggccccacacgugggacuuggucuagaaacaagaaccgaaacauggauguccucugaaggugccuggaaacaaauacaaaaaguggagacuugggcuuugagacacccaggauucacggugacagcccuuuuuuuagcacaugccauaggaacauccauuacucagaaagggaucauuuucauuuugcugaugcuaguaacaccaucaauggccaugcgaugugugggaauaggcaacagggacuucguugaaggacugucaggagcaacguggguggacguaguauuggagcauggaagcugcgucaccaccauggcaaaagauaaaccaacauuggacauugaacucuugaagacggaggucacaaacccugccgucuugcgcaaacugugcauugaagcuaaaauaucaaacaccaccaccgauucaagguguccaacacaaggagaggccacacugguggaagaacaagacucgaacuuugugugucgacgaacguuuguggacagaggcugggguaauggcugcggacuauuuggaaaaggaagccuacugacgugugcuaaguucaagugugugacaaaacuagaagggaagauaguucaauaugaaaacuuaaaauauucagugauagucacuguccacacuggggaccagcaccaggugggaaacgagacuacagaacauggaacaauugcaacuauaacaccucaagcuccuacgucggaaauacagcugacugacuacggagcccucacauuggacugcucaccuagaacagggcuggacuuuaaugagaugguucuauugacaaugaaagaaaaaucauggcuuguccacaaacaaugguuucuagacuuaccacugccuuggacuucaggagcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacgaucuuugcaggacaccugaaaugcagacuaaaaauggauaaacugacuuuaaaagggaugucauauguaaugugcacaggcucauuuaagcuagagaaggaaguggcugagacccagcauggaacuguucuagugcagguuaaauacgaaggaacagaugcaccaugcaagaucccuuuuucggcccaagaugagaaaggagugacccagaaugggagauugauaacagccaaccccauagucacugacaaagaaaaaccagucaacauugagacagaaccaccuuuuggugagagcuacaucgugguaggggcaggugaaaaagcuuugaaacugagcugguucaagaaagggagcagcauagggaaaauguucgaagcaacugcccgaggagcacgaaggauggcuauccugggagacaccgcaugggacuuuggcucuauaggaggaguguucacaucagugggaaaauugguacaccagguuuuuggagccgcauaugggguucuguucagcgguguuucuuggaccaugaaaauaggaauagggauucugcugacaugguugggauuaaauucaaggagcacgucacuuucgaugacgugcauugcgguuggcauggucacacuguaccuaggagucaugguucaagcggacucgggauguguaaucaacuggaagggcagagaacucaaauguggaagugguauuuuugucacuaaugaaguccacacuuggacagagcaauacaaauuccaggcugacuccccaaaaagacugucagcagccauugggaaggcaugggaagagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacauagauacucauggaaaagcuggggaaaagccaaaaucauaggagcagacauacagaauagcaccuucaucaucgacggcccagauacuccagaaugccccgaugaccaaagagcguggaacauuugggaaguugaagacuauggguuuggaauuuucacgacaaacauauggcugaaauugcgcgacuccuacacccaaaugugugaccaccggcuaauguccgcugccaucaaagacagcaaggcaguccaugcugacaugggguacuggauagaaagugaaaagaacgagaccuggaagcuagcgagagccuccuucauagaagucaagacauguaucuggccaaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuucgacuugugugaagguaccacaguuguuguggaugaacauuguggaaaucgaggcccaucucucagaacuacaacagucacaggaaagauaauccaugaaugguguugcagauccugcacguuaccccccuuacgcuucagaggagaagacggauguugguauggcauggaaaucagaccaguuaaggagaaggaggaaaaccuaguuaggucaauggucucugcagggucaggagaaguggacaguuuuucacuagggauacuaugcguaucaauaaugauugaagaagugaugagauccagauggaguagaaagaugcugaugacuggaacauuggcuguuuuccuccuucuuauaaugggacaacugacauggaaugaccugauuagguuaugcaucaugguuggagcuaaugcuucagacaggauggggaugggaacaacguaccuggccuugauggcuacuuucaaaaugagaccaauguucgcuguugggcuacuauuucgcagacuaacauccagagaaguucuucuucucacgauuggauuaagccugguggcauccguggaguuaccaaauucuuuggaggagcuaggggauggacuugcaauggguaucaugauguuaaaauuauugacugaauuucagccacaccaguuauggaccaccuuacugucuuugacauuuaucaaaacaacucuuucauuggauuaugcauggaggacaauggcuauggugcugucaaucguaucucucuuuccuuuaugucugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuuaaaaaugaugugccguuggccggcccacuaauagcuggaggcaugcuaauagcauguuaugucauauccggaagcucagccgauuuaucauuggagaaagcggcugagguauccugggaagaagaagcagaacacucugguaccucacacaacauauuaguagagguccaagaugauggaacuaugaaaauaaaagaugaagagagggaugacacacucaccauacuccucaaagcaacucugcuggcagucucaggaguguacccaaugucaauaccagcaacucuuuucgugugguauuuuuggcagaaaaagaaacagagaucaggaguguuaugggacacacccagcccuccggaaguggaaagagcaguucuugaugauggcaucuauagaauccugcaaagaggacuguugggcaggucccaagugggagugggaguuuuccaggacggcguguuccacacaauguggcacgucaccaggggagcuguccuuauguaccaagggaagagguuggaaccaagcugggccagugucaaaaaggacuugaucucauauggaggagguuggagauuucaaggaucauggaacacgggagaagaggugcaggugauagccguugaaccaggaaaaaauccuaaaaauguacagacaacgccggguaccuucaagacucccgaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaaacaucacaagaagggccucuaccagagauugaggaggagguguuuaagaaaaggaacuuaacaauaauggaccugcauccaggaucgggaaaaacaagaagauaucuuccagccauaguccgugaggccauaaaaaggaaacugcgcacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuaucuccagugagaguucccaauuacaacaugauuaucauggaugaagcacauuuuaccgauccagccagcauagcggccagaggguacaucucaacucgaguggguaugggugaagcagcugcgaucuuuaugacagccacucccccaggaucgguggaggccuuuccacaaaguaaugcaguuauccaagaugaggaaagagacauuccugagagaucauggaacucaggcuacgacuggaucacugauuuuccagguaaaacagucugguuuguuccaagcauuaagucaggaaaugacauugcuaacuguuuaagaaagaacggaaaacgggugauccaauugagcagaaaaaccuuugacacugaguaccagaaaacaagaaacaaugacugggacuauguugucacaacagacauuuccgaaaugggggcaaauuuccgggccgacaggguaauagacccaaggcggugcuugaaaccagugauacuaaaagaugguccagagcgugucauucuagccggaccgaugccagugacuguggccagugcugcccagagaagaggaagaauuggaaggaaccaaaacaaggaaggugaucaguacguuuauaugggacagccuuuaaauaaugaugaggaucacgcucauuggacagaagcaaaaaugcuccuugacaauauaaacacuccagaagggaucauuccagcccucuuugagccagagagagaaaagagugcagcaauagauggagaguacagacugcggggagaagcaaggaaaacguucguggagcucaugagaagaggagaucuaccaguuuggcuauccuacaaaguugccucagaagguuuccaguacuccgacagaagguggugcuuugacggggaaaggaacaaccagguguuggaggagaacauggacguggagaucuggacaaaggaaggagaaaggaagaaauugcgaccccgcugguuggaugccagaacauacucugauccacuggcccuucgugaguucaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuccuagcuuugauagcugugcugacugguggagugacgcuguucuuccuaucaggaaaaggucuagggaaaacauccauuggccugcucugugugauggccucaagcgcacuguuauggauggccaauguggagccacauuggauagcggccuccaucauacuagaguucuuucugauggugcugcucauuccagagccagacagacagcgcacuccacaggacaaccagcuagcauacguggugauagguuuguuauucaugauacugacaguggcagccaaugagaugggauuauuggaaaccacaaagaaagaccuggggauuggcuauguagccgccgaaaaccaacaccaugccacgaugcuggacguagaccuacgcccagcuucagccuggacccucuaugcaguagccacaacaguuaucacucccaugaugagacacacaauugaaaacacaacagcaaacauuucccugacagccauugcaaaccaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacaguuaggccaaauaauguuacugauacuuuguacaucacagauucucuugaugcggaccacaugggcccugugugaauccaucacacuggcuacuggacccuugaccacucucugggagggaucuccaggaaaauucuggaauaccacgauagcaguguccauggcaaacaucuucaggggaaguuaucuagcaggagcaggucuggccuucucguuaaugaaaucuuugggaggaggcaggagagguacgggggcucaaggagaaacacugggagagaaauggaaaagacaguuaaaccaacugagcaagucagaauucaacaccuacaaaaggagugggauuauggagguggacagauccgaagccaaagagggauuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagucaagggauacacaaaaggaggaccuggacaugaggaaccuaucccaauggcgaccuauggauggaaccuaguaaagcuauacucuggaaaagauguauuuuuuacaccaccugagaaaugugauacccuucugugugauauaggagaguccucuccgaauccaacuauagaagaaggaagaacguuacguguucuaaagaugguagaaccauggcucagaggaaaccaauucugcauaaaaauucuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaaugacucacaggaaaccaacauaugaaagagacguggacuuaggcgcuggaacaagacauguggcaguggaaccagagguagccaaccuagauauuauuggccagaggauagagaauauaaaaaaugaacacaagucaacaugguauuaugaugaagacaauccauacaaaacaugggccuaucauggaucauaugaggucaaaccaucaggaucagccucaucuauggugaauggcguggugagauugcucacaaaaccaugggaugucauccccauggucacacaaauagccaugaccgauaccacacccuucggacaacagagaguguuuaaagagaaaguagauacgcgcacgccgagagcaaaacgaggcacagcacaaauuauggaggugacagccaaguggcuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggaacuucauaaacagggaaaaugugccacgugugucuacaacaugauggggaagagagagaaaaaauugggagaguuuggaaaggcaaaaggaagucgugcaauaugguacauguggcugggagcacgcuuucuagaguucgaagcccuugguuucaugaaugaagaucacugguucaguagagagaauucauucaguggaguggaaggagaaggacugcacaaacuuggauacauacucagagacauaucaaagaucccggggggaaacauguaugcagaugacacagccggaugggacacaagaauaacagaggaugaucuucagaaugaggccaaaaucacugacaucauggagccugaacacgcucuauuagcuacgucaauuuuuaagcugaccuaccaaaacaaggugguaagggugcaaagaccagcaaaaaauggaaccgugauggauguuauauccagacgagaccagagaggaagugggcaggucggaaccuauggcuuaaauacuuucaccaauauggagguccaacuaauaagacaaauggagucugaaggaaucuuuuuacccagcgaauuggaaacccccaaucuagcugagagaguucuuaacugguuggaaaaacauggcacugaaaggcugaaaagaauggcaauuagcggagaugauuguguggugaaaccaguugaugacagguuugcaacagccuuaauagcucugaaugacaugggaaaaguaagaaaagacauaccgcagugggaaccuucaaaaggauggaaugacuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccuaagacuagcggcuaaugcuaucuguucagcugucccaguugacuggguuccaaccagccgcacaaccuggucaauccaugcucaccaucaauggaugacaacagaagauauguuaucaguguggaauaggguuuggauagaggaaaacccauggauggaggauaaaacucauguguccagcugggaagaagucccauacuuagggaaaagggaagaucaaugguguggaucccugauaggcuugacagcgagggccacuugggccacuaacauacaaguggccauaaaccaagugagaaggcucaucggaaaugagaauuaucuagauuacaugacaucaaugaagagauucaagaaugagagugaucccgaaggggcacucugguaa

SEQ ID NO: 5596 - RNA, 9879 nt, Artificial Sequence
  derived and/or modified CDS sequence (wt) from DENV-1__EU482609__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacuguuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacuaguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauagucaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaagcuagagaaggaaguggcugagacccaacauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagcgaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagguuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucacuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagcgaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcaugucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggagugguaacaacaaguggaaccuacgucagugccauugcccaagcuagagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaccagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuucccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugaccguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggauuaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacacugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacagucaucacucccaugaugagacacacaauugaaaauacaacggcaaacauuucccugacagccauugcaaaucaggcagcuauauugaugggacuugacaagggauggccaauaucaaagauggacauaggaguuccacuucucgccuuagggugcuauucccaggugaacccauugacacugacagcggcgguguugauguuaguggcucauuaugccauaauuggaccaggacugcaagcaaaagccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaacccaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaacccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuaucggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaggugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuucacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5597 - RNA, 9879 nt, Artificial Sequence
  derived and/or modified CDS sequence (wt) from DENV-1__EU482610__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcugguguaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuuggguuuugagacacccaggauucacggugauagccuuuuuuuuagcacaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaacucacagugguuguaggagaugccaacggaauuuuggcccaagggaaaaaaaugauuaggccacaaccuauggaacacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggaguaggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagacuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuauaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuauaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacaucuagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaagcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacuuagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggaugucauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacuggcuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 5598 - RNA, 9879 nt, Artificial Sequence
  derived and/or modified CDS sequence (wt) from DENV-1__EU482611__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcugguguaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauacgggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaacucacagugguuguaggagaugccaacggaauuuuggcccaagggaaaaaaaugauuaggccacaaccuauggaacacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaaccaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggaguaggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuauaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaaggaaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacaucuagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagccaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaagcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacuuagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggaugucauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacuggcuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaagacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 5599 - RNA, 9879 nt, Artificial Sequence
  derived and/or modified CDS sequence (wt) from DENV-1__FJ639735__SS-prME
uccgugaccaugcuccucaugcugcugcccacagcccuggcguuccauuugaccacacgagggggagagccacacaugauaguuaguaagcaggaaagaggaaagucacucuuguuuaagaccucggcaggugucaauaugugcacucucauugcgauggacuugggagaguuaugugaggacacaaugaccuacaaaugcccccggaucacugaggcggaaccagaugacguugacugcuggugcaaugccacagacacaugggugaccuauggaacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugacagcccuuuuuuuagcacaugccauaggaacauccaucacucagaaagggaucauuuucauuuugcuaaugcuggugacaccaucaauggccaugcgaugcgugggaauagguaacagagacuucguugaaggacugucaggagcaacguggguggacgugguauuggagcauggaagcugcgucaccaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaggggacgucauaugugaugugcacaggcucauuuaagcuagagaaggaaguggcugagacccaacauggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaacugcccgaggagcacgaaggauggcuauccugggagacaccgcaugggacuucggcucuauaggaggaguguucacaucuguaggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucauagacggcccagauaccccagaaugccccgaugaccaaagagcguggaacauuugggaaguugaggacuauggguuuggaauuuucacgacuaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuuaacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucgauggucucugcagggucaggagaaguggauaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacucagguaccucacacaacauauuaguagagguccaagaugauggaacuaugaaaauaaaagaugaagagaaggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcagaucccaagugggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcucaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuauccccagugagaguucccaauuacaacaugauuguuauggaugaagcacauuuuaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaacgaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuauuggaaaccacaaagagagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaaugcuacugauacuuuguacaucacagauccucuugaugcggaccacaugggccuugugugaauccaucacacuggcgacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagccaugaccgauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauaucuagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5600 - RNA, 9879 nt, Artificial Sequence
  derived and/or modified CDS sequence (wt) from DENV-1__FJ639740__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugcuauaggaacauccaucacucagaaagggaucauuuucaucuugcugaugcuggugacaccaucaauggccaugcgaugugugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacgcuuguggacagaggcugggguaauggcugcggacuauucggaaagggaagucuauugacgugugccaaguucaagugugugacaaaacuagaaggaaagauaguucaauaugaaaacuugaaauauucagugauagucacuguccacacuggggaccagcaccaggugggaaacgagaccacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuuugcgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuucaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucccacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucucugacauuugucaaaacaacucuuucauuggauuaugcauggaaaacaacggcuaugguacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaagaaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcaucaaaucaggaaaugacauugccaacuguuuaagaaagaacggaaaacggguaauccaauugagcagaaaaaccuuugacacugaguaccagaaaacaaaaaacaaugacugggauuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacaucuauuggcuugcucugugugacggccucaagcgcacuguuauggauggccaguguggagccccacuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaucaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuagcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagaggaagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaagugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggagggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccacagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaucuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5601 - RNA, 9879 nt, Artificial Sequence
  derived and/or modified CDS sequence (wt) from DENV-1__FJ639741__SS-prME
uccgugaccauacuccucaugcugcugcccacagcccuggcguuccauuugaccacacgagggggagagccacacaugauaguuaguaagcaggaaagaggaaagucacucuuguuuaagaccucugcaggugucaacaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacccagaaagggaucauuuucauuuugcugaugcuggugacaccaucaauggccaugcgaugugugggaauaggcaauagagacuucguugaaggacugucaggagcaacguggguggacgugguauuggagcauggaagcugcgucaccaccauggcaaaaaauaaaccaacauuggacauugaacucuugaagacggaagucacgaacccugccgucuugcgcaaacugugcauugaagccaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucggggacuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaagggaacgucauaugugaugugcacaggcucauuuaagcuagagaaggaaguggcugagacccagcauggaacuguuuuagugcaggucaaauacgaaggaacagacgcgccaugcaagauccccuuuucgacccaagaugagaaaggagugacccagaaugggagauugauaacagccaauccuauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccauacuuggacagagcaauacaaguuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacagcccauggaacacaaauacucauggaaaagcuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaaacuggcgaaagccuccuucauagaagucaagacaugcaucuggccgaaaucccacacucuauggagcaauggaguuuuggaaagugaaaugauaauuccaaagauauauggaggaccaauaucucagcacaacuauagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucucauaaugggacaacugacauggaaugaucugauuagguuaugcaucaugguuggagcuaaugcuucagacaggauggggaugggaacaacguaccuagccuugauggccacuuucaaaaugagaccaauguuugcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuaugguacugucaauuguaucucucuuuccuuuaugccugucuacgaccucccaaaaaacaacauggcuuccggugcuguuaggaucuuuuggaugcaaaccacuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcguguuaugucauauccggaagcucagccgauuuaucauuggagaaagcggcugagguguccugggaacaagaagcagaacacuccgguaccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauacggaggagguuggagguuucaaggaucauggaacacgggagaagaagugcagguaauagcuguugaaccaggaaaaaaccccaaaaauguacagacaacgccggguaccuucaagacuccugaaggugaaguuggagccauagcucuagauuuuaaacccggcacaucugggucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuugacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaauucaggcuacgacuggaucacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagauggcccagagcgugucauucuagcuggaccgaugccagugacuguggccagugcugcccagaggagaggaagaauuggaaggaaccaaaacaaggaaggugaucaguaugucuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcgaggagaagcaaggaaaacauucguggagcucaugagaagaggagaucuaccaguuuggcuauccuacaaaguagccucagaagguuuccaguacuccgacagaagguggugcuuugauggagaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaacuccgaacaaggaggaaaagccuauagacaugcuauggaggaacuaccagacacuauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuucugauggugcugcucauuccagagccagacagacagcgcacuccacaggacaaccaguuagcauauguggugauagguuuguuauucaugauacugacaguggcagccaaugagaugggauuauuggaaaccacaaagaaagaccuggggauuggccauguagccgccgaaaaccaccaacaugcuacaaugcuggacguagaccuacguccagcuucagccuggacucuuuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggaucguugcaauagacuuggauccugugguuuaugaugcaaaauuugaaaaacagcuaggccaaauaauguuacugauacuuuguacaucacagauccucuugaugcgaaccacaugggccuugugugaauccaucacacuggcuaccggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagaaaaauggaaaagacaguuaaaccaacugagcaagucagaauucaacaccuacaaaaggagugggauuauggagguggacagguccgaagccaaagagggacugaaaagaggagaaacaacuaaacaugcagugucgagaggaacagccaaacugaggugguuuguggagaggaaccucgugaaaccagaaggaaaagucauagaccucgguuguggaagagguggcuggucauauuauugugcugggcugaagaaagucacugaagugaaaggauacacaaaaggaggacuuggacaugaggaacccaucccaauggcgaccuauggauggaaccuagugaagcuacacucuggaaaagauguauuuuuuaugccaccugagaaaugugacacccuucugugugauauuggugaguccucuccgaacccaacuauagaagaaggaagaacguuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguugcugaaucgauucacaauggcucacaggaagccaacauaugaaagagacguggacuuaggcgcuggaacaagacaugucgcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugaaauugcucacaaaaccaugggaugucauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuuggaaucucgugcacagagagagggagcuucauaaacagggaaaaugugccacgugugucuacaacaugauggggaagagagagaaaaaguuaggagaguuuggaaaagcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaacauguaugcagaugauacagccggaugggacacaagaauaacagaggaugaucuucagaaugaggcuaaaaucacugacaucauggagccugaacaugcucuauuggcuacgucaauuuuuaagcugacuuaucaaaauaagguggugagggugcaaagaccagcaaaaaauggaaccgugauggauguuauauccagacgugaccagagaggaaguggacaggucggaacauauggcuuaaauacuuucacuaauauggagguccaacuaauaagacaaauggagucugaaggaaucuuuuuacccagcgaacuggaaacccccaaucuagcugagagaguccuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcaacugauguacuuccacaggagagaccugagacuagcggcuaacgcuaucuguucagccgucccaguugauugggucccaaccagccguacaaccuggucaauccaugcccaccaccaauggaugacaacagaagacauguuaucaguguggaauaggguuuggauagaggaaaacccauggauggaggacaaaacucauguaucuaguugggaagaaguuccauaccuagggaaaagggaagaucaaugguguggaucccuaauaggcuugacagcgagggccaccugggccaccaacauacaaguagccauaaaccaagugagaaggcucaucgggaaugagaauuaucuagauuacaugacaucaaugaagagguucaagaaugagagugaucccgaaggggcacucugguaa

SEQ ID NO: 5602 - RNA, 9879 nt, Artificial Sequence
  derived and/or modified CDS sequence (wt) from DENV-1__FJ639743__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauggcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucagauacgaaggaacagacgcgccaugcaagauccccuuuucgacccaagaugagaaaggagugacccagaaugggagauugauaacagccaauccuauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggccauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguugugggagaugcuaacggaauuuuggcccaaggaaaaaaaaugauuaggccacaacccauggaacacaaauacucauggaaaagcuggggaaaagcuaaagucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuguaaugggacaacugacauggaaugaucugauuagguuaugcaucaugguuggagccaaugcuucagacaggauggggaugggaacaacguaccuagccuugauggcuacuuucaaaaugagaccaauguucgcuguugggcuauuauuccgcagacuaacauccagagaaguccuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucucugacauuugucaaaacaacucuuucauuggauuaugcauggaaaacaacggcuaugguacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggcgccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuucugaaggcgaaguuggagccauagcucuagauuucaaacccggcacaucuggaucccccauugugaacagagagggaaaaauagugggucuuuauggaaauggaguggugacaacaaguggaaccuacguuagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaauucaggcuacgacuggauuacugauuuuccagguagaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagaggcacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaggugaagggauacacaaaaggaggaccuggacaugaggaaccuaucccaauggcgaccuauggauggaaccuaguaaagcuacacucuggaaaagauguauuuuuuaugucaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagaggaagccaaccuagauaucauuggccagaggauagagaauauaagaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaacauggagguccaacuaauaagacaaauggagucugaaggaaucuuuuuacccagcgaauuggaaacccccaaccuagcugagagaguucuugacugguuggaaaaacacggcgccgaaaggcugaaacgaauggcaaucagcggagaugauugcguggugaaaccaauugacgacagguucgcaacagccuuaacagcucugaaugacaugggaaaaguaagaaaagacauaccacagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5603 - RNA, 9879 nt, Artificial Sequence
  derived and/or modified CDS sequence (wt) from DENV-1__FJ639794__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauuguaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugacaugaaauucacagugguuguaggagaugcuaacggaauuuuggcccaagggaaaaaaaugauuaggccacaacccauggaacacaaauacucauggaaaagcuggggaaaagccaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacuuaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauuuuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgccauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaaugguucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccaggggggaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcuggucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5604 - RNA, 9879 nt, Artificial Sequence
  derived and/or modified CDS sequence (wt) from DENV-1__FJ639796__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaucagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaaggaaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuugcguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcaugucaccaggggagcuguccuuauguaccaagggaaaaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuucaccaugcgucuuuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5605 - RNA, 9879 nt, Artificial Sequence
  derived and/or modified CDS sequence (wt) from DENV-1__FJ639797__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacuaugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaaucgcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacaacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauauaaauuccaggcugacuccccaaaaagacugucagcagccauuggaagggcaugggaggagggaguguguggaauucgaucagccacgcgucuugagaacaucauguggaagcaaauaucaaaugaauugaaccacauucuacuugaaaaugacaugaaauucacagugguuguaggagacgcuaacggaauuuuggcccaagggaagaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaucuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgcgucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauauugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaaugcuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaacaaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauuguaucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5606 - RNA, 9879 nt, Artificial Sequence
  derived and/or modified CDS sequence (wt) from DENV-1__FJ639802__SS-prME
uccgugacuaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuuaagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacauugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagccuugaaacuaagcugguucaagaaaggaagcagcauagggaaaauguuugaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacagauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaucuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcggugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcuaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagcuaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagcugucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5607 - RNA, 9879 nt, Artificial Sequence
  derived and/or modified CDS sequence (wt) from DENV-1__JN819410__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacgcuuguggacagaggcugggguaauggcugcggacuauucggaaagggaaaucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagaugcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaacccauggaacacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuuaucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaaucuaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucgaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 5608 - RNA, 9879 nt, Artificial Sequence
  derived and/or modified CDS sequence (wt) from DENV-1__FJ639806__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacuaugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaaucgcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacaacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauauaaauuccaggcugacuccccaaaaagacugucagcagccauuggaagggcaugggaggagggaguguguggaauucgaucagccacgcgucuugagaacaucauguggaagcaaauaucaaaugaauugaaccacauucuacuugaaaaugacaugaaauucacagugguuguaggagaugcuaacggaauuuuggcccaagggaagaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaucuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcauaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaaugcuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaacaaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauuguaucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugacgaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguugaaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5609 - RNA, 9879 nt, Artificial Sequence
  derived and/or modified CDS sequence (wt) from DENV-1__JN819411__SS-prME
uccgugaccaugcuccucaugcugcugcccacagcccuggcguuccauuugaccacacgagggggagagccacacaugauaguuagcaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaucgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcggcguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccgacuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauagugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcaugucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggagugguaacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaagccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaacccgucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaacccuuacaugccaagugugguagaaacucuggagcaaaugcaaagaaaacauggagggaugcuagugcgaaauccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaaguuaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaaccuagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuucacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcuuugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccacuugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5610 - RNA, 9879 nt, Artificial Sequence
  derived and/or modified CDS sequence (wt) from DENV-1__FJ639812__SS-prME
uccgugaccaugcuccucaugcuguugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagaugaugcuauugacaaugaaagaaaaaucauggcuuguccacaaacagugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaaguuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuauuauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacggacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggagggugaucaguauguuuacaugggacagccuuuaaauaaugaugaggaucacgcucauuggacagaagcaaaaaugcuccuugacaacauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaacuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaaaauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacucuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagagacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccguuccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5611 - RNA, 9879 nt, Artificial Sequence
  derived and/or modified CDS sequence (wt) from DENV-1__FJ639813__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggccuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucaugaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguaacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauuuuguugacaugguugggauuaaauucaaggagcacgucauuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaagcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcaugucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaacccuaaaaauguacagacaacgccggguaccuucaagacuccugaaggcgaaguuggagccauagcucuagauuucaaacccggcacaucuggaucucccauugugaacagagagggaaaaauagugggucuuuauggaaauggagugguaacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaacaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaacccaugccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaacccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaaaccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacucggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuucacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugauaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5612 - RNA, 9879 nt, Artificial Sequence
  derived and/or modified CDS sequence (wt) from DENV-1__JN819412__SS-prME
uccgugaccaugcuccucaugcuguugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacagugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaaguuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuauuauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacggacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaacauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaacuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaaaauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacucuguacaucacagauccuuuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagagacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagauguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccguuccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5613 - RNA, 9879 nt, Artificial Sequence
  derived and/or modified CDS sequence (wt) from DENV-1__FJ810415__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugacuuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucaaaaaggggucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaaacugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaacccauggaacacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauugguuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagaggcacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugacaccacacccuuuggacaacagagaguguuuaaagagaaaguugacacgcgcacaccaagagcaaaacgaggcacaacacagauuauggaggugacagccaaaugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 5614 - RNA, 9879 nt, Artificial Sequence
  derived and/or modified CDS sequence (wt) from DENV-1__FJ639814__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuuggcccaagggaaaaaaaugauuaggccacaacccauggaacacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuuaacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggagugguaacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacaucuagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacuuagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 5615 - RNA, 9879 nt, Artificial Sequence
  derived and/or modified CDS sequence (wt) from DENV-1__FJ639815__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaagcaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuuggcccaagggaaaaaaaugauuaggccacaacccauggaacacaaauacucauggaaaagcuggggaaaagcuaaaaucauaggagcagacauacaaaacacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugcuacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauaucaggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccagcaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacaucuagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaagcccagaaucugcacaagagaggaguucacaagaaagguuaggucaaacgcggcaauaggagcaguuuucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacuuagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 5616 - RNA, 9879 nt, Artificial Sequence
  derived and/or modified CDS sequence (wt) from DENV-1__FJ639818__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaacaccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaauccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuugaaauauucagugauaguuaccguccacacuggggaccagcaucagguggggaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggaaaaacugacuuuaaaggggaugucauaugugaugugcacaggcucauucaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggaaggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcuuaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacacaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauccuacuaaguucacuccuaaaaaaugaugugccauuggccggcccacuaauagcuggaggcaugcuaauagcauguuaugucauauccggaagcucagccgauuuaucacuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcgcacguuaaucuuggcucccacaagaguuguugccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacuccuccaggaucgguggaggccuuuccacagagcaaugcaguuauccaagaugaggaaagagacauuccugagagaucauggaacucaggcuacgacuggaucacugacuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacauacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuagauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcgguguuuguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggccacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgccaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauagguuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5617 - RNA, 9879 nt, Artificial Sequence
  derived and/or modified CDS sequence (wt) from DENV-1__FJ639819__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacaugugggacuuggucuagaaacaagaaccgaaacauggauguccucugaaggcgccuggaaacaaauacaaagaguggagacuugggcuuugagacacccaggauucacggugauagccuuuuuuuuagcacaugcuauaggaacauccaucacucagaaagggaucaucuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcuggggcaauggcugcggacuauucggaaagggaagucuauugacgugugccaaguucaagugugugacaaaacuagaaggaaagauaguucaauaugaaaacuuaaaauacucagugauagucacuguccacacuggggaccagcaccaggugggaaacgagaccacagaacauggaacaauugcaaccauaacaccacaagcuccgacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaguugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcagacucgggauguguaaucaacuggaagggcagagaacuuaaauguggaaguggcauuuuugucacuaaugaaguucacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacgcuaccccccuuacguuucagaggagaagacggauguugguauggcauggaaaucagaccaguaaaggagaaggaggagaaucuaguuaggucaauggucucugcagggucaggagaaguggacaauuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucucugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagcugauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccugugucaaaaaggacuugaucucauauggaggagguuggagguuucaaggauuauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaagcggaaccuacgucagugccauugcccaagcuaaagcaucacaggaagggccucuaccagagaucgaggacgagguguuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccaggcaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagauggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcccugcgcgaguuuaaagaguuugcagcaggaagaagaagugucucaggugaccugauauuggaaauagggaaacuuccacaacauuugacgcuaagagcccagaaugcccuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaagguuuagggaaaacauccauuggcuugcucugugugacggccucaagugcacuguuauggauggccaguguggagccccauuggauagcggccuccaucauacuagaguucuuuuugauggugcugcucauuccagagccagacagacagcgcacuccacaggacaaccagcuagcauauguggugauaggcuuguuauucaugauacuuacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacgcugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccagauaauguuacugauacuuuguacaucacagauccucuugaugcggaccacaugggccuugugugaauccaucacacuggcuacuggaccccugacuacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggagccuaucccaauggcgaccuauggauggaaccuaguaaagcuacacucuggaaaagauguauuuuucaugccaccugagaaaugugacacccuucugugugauauuggugaguccucuccaaauccaaccauagaagaaggaagaacguuacguguucuaaaaaugguggaaccauggcucagaggaaaccaauucugcauaaaaaucuuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaaugcuacugaaccgauucacaauggcucacaggaagccaacauaugaaagagauguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugacgaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacucggauacauacucagagacauaucaaagauuccggggggaaacauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaagggaucuuuuuacccagcgaauuggaaacccccaaccuagcugagagaguucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaucugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5618 - RNA, 9879 nt, Artificial Sequence
  derived and/or modified CDS sequence (wt) from DENV-1__FJ639820__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuuuguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagagcauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaagcuagagaaggaaguggcugagacccagcauggaacuguucuagugcaggucaaauacgaaggaacagacgcgccaugcaagaucccauucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagugguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccacaggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaauuccaaagauauauggaggaccaauaucucagcacaacuacaggccaggguauuucacacaaacagcagggccauggcaucuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuuuagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaagccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaggaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcaugucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcaggaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggccauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccacuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguggaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccuuagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuaucuagauuauaugacaucaaugaagagauucaagaaugagagugauccugaaggagcacucugguaa

SEQ ID NO: 5619 - RNA, 9879 nt, Artificial Sequence
  derived and/or modified CDS sequence (wt) from DENV-1__FJ639821__SS-prME
uccgcgaccaugcuccucaugcugcugcccacagcccuggcguuccauuugaccacacgagggggagagccacacaugauaguuaguaagcaggaaagaggaaagucacucuuguuuaagacuucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggagacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauagguaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauacucagugauagucacuguccacacuggggaccagcaccaggugggaaacgagaccacagaacauggaacaauugcaaccauaacaccacaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagauuuaccacugccauggacuucgggggcuucaacaucucaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucagauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaguugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcagacucgggauguguaaucaacuggaagggcagagaacuuaaauguggaaguggcauuuuugucacuaacgaaguucacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaucaccggcuaaugucagcugccaucaaggacagcaaggcaguccaugcugacaugggguacuggauagaaagugaaaagaacgaaaccuggaagcuggcgagagccuccuucauagaagucaagacaugcacuuggccgaaaucucacacucuauggagcaauggaguuuuggaaagugaaaugauaaucccaaagauauauggaggaccaauaucucagcacaacuacagaccaggguauuacacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggauguugguauggcauggaaaucagaccaguaaaggagaaggaggagaaucuaguuaggucaauggucucugcagggucaggagaaguggacaauuuuucauuaggaauacuauguguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacgggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucucugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggccauuggaauagucagcauucuacuaaguucacuccucaaaaaugaugugccguuggccggcccacuaauagcuggaggcaugcuaauagcauguuaugucauauccggaagcucagcugauuuaucauuggacaaagcggcugaaguauccugggaacaagaagcagaacacuccggugccucacacaacauaucaguagagguccaagaugauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccugugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaagcggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuaucuccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccaggcaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacagggugauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuucgagccagagagagaaaagagugcagcaauagauggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcccugcgcgaguuuaaagaguuugcagcaggaagaagaagugucucaggugaccuaauacuggaaauagggaaacuuccacaacauuugacgcuaagagcccagaaugcccuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaagguuuagggaaaacauccauuggcuugcucugugugacggccucaagugcacuguuauggauggccaguguggagccccauuggauagcggccuccaucauacuagaguucuuuuugauggugcugcucauuccagagccagacagacagcgcacuccacaggacaaccagcuagcauauguggugauaggcuuguuauucaugauacuuacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaacacaacggcaaacauuucccugacagccauugcaaaucaggcagcuauauugaugggacuugacaagggauggccaauaucgaagauggacauaggaguuccacuucucgccuuagggugcuauucccaggugaacccauugacgcugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccuguggucuaugauguaaaauuugaaaaacagcuaggccaaauaauguuacugauacuuuguacaucacagauccucuugaugcggaccacaugggccuugugugaauccaucacacuggcuacuggaccccugacuacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaucaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggagccuaucccaauggcgaccuauggauggaaccuaguaaagcuacacucuggaaaagauguauuuuucaugccaccugagaaaugugacacccuucugugugauauuggugaguccucuccgaauccaaccauagaagaaggaagaacguuacguguucuaaaaaugguggaaccauggcucagaggaaaccaauucugcauaaaaaucuuaaauccuuacaugccaagugugguagaaacucuugagcaaaugcaaagaaaacauggagggaugcuagugcgaaacccacucucaagaaauucuacccaugaaauguauuggguuucauguggaacaggaaacauugugucggcagugaacaugacauccagaaugcuacugaaccgauucacaauggcucacaggaagccaacauaugaaagagauguggacuuaggcgcuggaacaagacaugugacaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcguacaccaagagcaaaacgaggcacaacacaaauuauggaggugacagccaagugguuaugggguuuccuuuccagaaacaaaaaacccagaaucugcacaagagaggaguucacaagaaaggucaggucaaacgcggcaauaggggcaguguucguugacgaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuuuuggaguucgaagcccuugguuucaugaaugaagaucacugguuuaguagagagaauucacucaguggaguggaaggagaaggacugcacaaacucggauacauacucagagacauaucaaagauuccggggggaaacauguaugcagaugauacagccggaugggacacaagaauaacagaggaugaucuccagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaucugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuggauuacaugacaucaaugaagagauucaagaaugagagugaucccgaaggagcacucugguaa

SEQ ID NO: 5620 - RNA, 9879 nt, Artificial Sequence
  derived and/or modified CDS sequence (wt) from DENV-1__FJ639824__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggaccucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauacggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacgcuucagaggagaagacggauguugguaugguauggaaaucagaccaguaaaggagaaggaggagaaucuaguuaggucaauggucucugcagggucaggagaaguggacaguuuuucauuaggaauacuaugcgugucaauaaugauugaagaagugaugagaucuagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaguagcuggaggcaugcuaauagcauguuaugucauauccggaagcucagccgauuuaucauuggagaaagcggcugagguguccugggaacaagaagcagaacacuccggugcuucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcaugucaccaggggagcuguccuuauguaccaagggaagaggcuggaaccaagcugggccagcgucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccgcuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccaugcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauaggucuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggacuacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaaggggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5621 - RNA, 9879 nt, Artificial Sequence
  derived and/or modified CDS sequence (wt) from DENV-1__JN819425__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcuuuuuuuuuagcacaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagacuuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaacccauggaacacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaagaaugaugugccguuggccgggccacuaauagcuggaggcaugcuaauagcauguuaugucauauccggaagcucagccgauuuaucauuggagaaagcggugaaaauauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 5622 - RNA, 9879 nt, Artificial Sequence
  derived and/or modified CDS sequence (wt) from DENV-1__FJ850099__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuggcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauagucacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguucacaucugugggaaaauugguacaccagguuuuuggaaccgcauaugggguucuguucagcgguguuucuuggaccaugaagauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacauuauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagauauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggccacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguccuugaugauggcaucuauagaaucuugcaaagaggacuguugggcaggucccaaguaggagugggagucuuccaagacggcguguuccacacaauguggcaugucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagaggggaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugauggggcuugacaagggauggccaauaucgaagauggacauaggaguuccacuucuugccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucuuugggagggaucuccaggaaaauucuggaauaccacgauagcaguguccauggcaaacaucuucaggggaaguuaucuagcaggagcagguuuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuauccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuuuuguucacaccauuuccaucagcugaucaugaaggaugggagggaaauaguggugccaugccgcaaccaagaugaacuugugggcagggccagaguaucgcaaggcgccggauggagccugagagagacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5623 - RNA, 9879 nt, Artificial Sequence
  derived and/or modified CDS sequence (wt) from DENV-1__FJ850100__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggauuacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacaaauccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauacucagugauaguuaccguccacacuggggaccagcaucagguggggaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggacaaacugacuuuaaaggggaugucauaugugaugugcacaggcucauucaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacauuauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucuuagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacgcaccuagccuugauggcuacuuucaaaaugagaccaauguucgcuguugggcuauuauuccgcagauuaacauccagagaaguucuucuccucacgauuggauuaagccugauggcauccauggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugauacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagagucguugccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucaccgacuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcggccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcacacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccggcuucagccuggacccucuaugcaguagccacaacaguuaucacucccaugaugagacauacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuagauccugugguuuaugaugcaaaauuugaaaaacagcuaggccaaauaauguuacugauacuuuguacaucacagauccucuugaugcggaccacaugggccuugugugaauccauuacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaguggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaagcccagaaucugcacaagagaggaguucacaagaaaaguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccagaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaucaagaugaacuugugggcagggccagaguaucgcaaggcgccggauggagccugagagaaacugcuugccuaggcaagucauaugcacaaauguggcagcugauguacuuccacaggagagaccugagacuagcggcuaacgccaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5624 - RNA, 9879 nt, Artificial Sequence
  derived and/or modified CDS sequence (wt) from DENV-1__FJ882579__SS-prME
uccgugaccaugcuccucaugcuauugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggccuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacagugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauacgugaugugcacaggcucauucaaguuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuugacccaaggaaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacucuuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccagugaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuauuauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagccaaagcaucacaggaagggccucuaccagagauugaggacgagguguuuaagaaaagaaacuuaacaauaauggaucugcacccaggaucaggaaaaacaagaagauaucuuccagccauaguccgugaggccauaaaaaggaaacugcguacguuaaucuuggcucccacaagagucgucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaagccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacggacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaacauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaacuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaaaauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacucuguacaucacagauccucuugaugcggaccacaugggccuugugugaauccaucacacuggcuacuggaccccugaccacucucugggagggaucuccaggaaaauucuggaauaccacgauagcagugucuauggcaaacaucuucaggggaaguuaucuagcaggagcaggucuggcuuuuucauuaaugaaaucuuuaggaggagguaggagaggcacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacgcuacguguucuaaaaaugguggaaccauggcucaaaggaaaccaauucugcauaaaaauccuaaauccuuacaugccaagugugguagagacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccguuccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5625 - RNA, 9879 nt, Artificial Sequence
  derived and/or modified CDS sequence (wt) from DENV-1__JN819414__SS-prME
uccgugaccaugcuccucaugcuguugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcauaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacacuaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucaggugggaaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacagugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauucaaguuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacaucauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucucagaacuacaacagucacaggaaagauaauccaugaaugguguugcagaucuugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuucuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagauuaacauccagagaaguucuccuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuauuauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgagguuggagccauagcucuagauuucaaacccggcacaucuggaucucccauugugaacagagagggaaaaauagugggucuuuauggaaauggaguggugacaacagguggaaccuacguuagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaauuguuuaagaaagaacggaaaacggguaauccaacugagcagaaaaaccuuugacacugaguaccagaaaacaaaaaacaaugacugggacuauguugucacaacggacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaacauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaacuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaaaauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaagcagcuaggccaaauaauguuacugauacucuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagagacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauauuauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuauggggcuuccuuuccagaaacaaaaaacccagaaucugcacaagagaggaguucacaagaaagguuaggucaaacgcggcaauaggagcaguguucguugaugaaaaccaauggaacacggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacuuaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuuuaccaauauggagguccaacuaauaagacaaauggagucugaaggaaucuuuuuacccagcgaauuggaaacucccaaccuagcugagagagcucuugacugguuggaaaaacauggcgccgaaaggcugaaacgaauggcaaucagcggagaugauugcguggugaaaccaauugacgacagguucgcaacagccuugacagcucugaaugacaugggaaaaguaagaaaagacauaccgcagugggagccuucaaaaggauggaaugauuggcagcaagugccuuucugcucacaccauuuccaccagcugaucaugaaggaugggagggaaauaguggugccaugccgcaaccaagaugaacuugugggcagggccagaguaucgcaaggcgccggauggagccugagagaaacugcuugccuaggcaagucauaugcacaaauguggcagcugauguacuuccacaggagagaccugagacuagcggcuaacgcuaucuguucagccguuccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5626 - RNA, 9879 nt, Artificial Sequence
  derived and/or modified CDS sequence (wt) from DENV-1__FJ873810__SS-prME
uccgugaccaugcuccucaugcugcugcccacagcccuggcguuucauuugaccacacgagggggagagccacacaugauaguuaguaagcaggaaagaggaaagucacucuuguuuaagaccucugugggcgucaauaugugcacccucauugcgauggacuugggagaguuaugugaggacacaaugaccuacaaaugcccccggaucacugaggcggaaccagaugacguugacugcugguguaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugcugucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuuggcccaagggaaaaaaaugauuaggccacaaccuauggagcacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacuauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggaguaggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacaucuagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaagcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacuuagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggaugucauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacuggcuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 5627 - RNA, 9879 nt, Artificial Sequence
  derived and/or modified CDS sequence (wt) from DENV-1__FJ850103__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuagccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccauuacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucacuaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauaggaaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaacccauggaacacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaucuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagcuuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccaguccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuauauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaguccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaauuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaaccauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugaaauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuucaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaucaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccacuaacauacaaguagccauaaaccaagugagaaggcucaucgggaaugagaauuauuuagauuacaugacaucaaugaagagauucaagaaugagagugaucccgaaggagcacucugguaa

SEQ ID NO: 5628 - RNA, 9879 nt, Artificial Sequence
  derived and/or modified CDS sequence (wt) from DENV-1__FJ850104__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugucacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugcuauaggaacauccaucacucagaaagggaucauuuucaucuugcugaugcuggugacaccaucaauggcuaugcgaugugugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuugaaauauucagugauagucacuguccacacuggggaccagcaccaggugggaaacgagaccacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagaugcgccaugcaagauccccuuuucgacccaagaugagaaaggagugacccagaaugggagauugauaacagccaauccuauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugauaugaaauucacagugguuguaggagaugcuaacggaaucuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaaccacagaccaggguauuucacacaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucucugacauuugucaaaacaacucuuucauuggauuaugcauggaaaacaacggcuaugguacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugacgugccguuggccggcccacuaauagcuggaggcaugcugauagcauguuaugucauauccggaagcucagccgauuuaucauuggagaaagcggcugagguguccugggaacaagaagcagaacacuccggugccucacacaacauacuaguagagguccaagaugauggaacuaugaaaauaaaagaugaagagagggaugacacacucacuauacuccuuaaagcaacucugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaacggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuaccuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcagucauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacuccgauccacuggcccugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcccauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucagaggaaaucaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagaggaagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaauuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuucuuacccagcgaauuggaaacccccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccacagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugccugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauagguuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5629 - RNA, 9879 nt, Artificial Sequence
  derived and/or modified CDS sequence (wt) from DENV-1__JN819405__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggauuacugaggcggaaccagaugacguugacugcuggugcaacgccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagaccugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacaaauccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaacggcugcggacuauucggaaagggaagucuauugacgugugccaaguucaagugugugacaaaacuagaaggaaagauaguucaauaugagaacuuaaaauauucagugauaguuaccguccacacuggggaccagcaucagguggggaacgagaccacagaacauggaacaauugcaaccauaacaccucaagcuccuacgucggaaauacagcugaccgacuacggagcccuuacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggacaaacugacuuuaaaggggaugucauaugugaugugcacaggcucauucaagcuagagaaggaaguggcugagacccagcauggaacuguucuagugcaggucaaauacgaaggaacagacgcgccaugcaagauccccuucucgacucaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucuguugacaugguugggauuaaauucaaggagcacgucacuuucgaugacgugcauugcaguuggcauggucacacuguaccuaggagucaugguucaagcggacucgggaugugugaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggaguguguggaauucgaucagccacgcgucuugagaacauuauguggaagcaaauaucaaaugaauugaaccacauucuacuugaaaaugauaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuuuaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguucaugcugacaugggguacuggauagaaagugaaaagaacgaaaccuggaagcuggcgagagccuccuucauagaagucaagacaugcaccuggccaaaaucucacacucuauggagcaauggaguuuuggaaagugaaaugauaaucccaaagauauauggaggaccaauaucucagcacaacuacaggccaggguauuucacacaaacagcagggccauggcaccuagguaaguuggaacuggauuuugacuugugugaaggcaccacaguuguuguggaugaacauuguggaaaucgagguccaucucuuagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacgcaccuagccuugauggcuacuuucaaaaugagaccaauguucgcuguugggcuauuauuccgcagauuaacauccagagaaguucuucuccucacgauuggauuaagccugauggcauccauggagcuaccaaauucuuuggaggagcuaggggauggacuugcaauggguaucaugauguuaaaauuguugacugaauuucagccacaccaguuauggaccaccuuacugucuuugacauuugucaaaacaacucucucauuggauuaugcauggaaaacaacggcuaugauacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccuaaaaaaugaugugccauuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagauuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguuguugccucugaaauggcagaggcacucaagggaaugccaauaagauaucagacaacagcagugaagagugaaaccacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucaccgacuuuccagguaaaacagucugguuuguuccaagcauuaaaucaggaaaugacauugccaacuguuuaagaaagaacggaaaacggguaauccaacugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagagaagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcggccucgcugguuggaugccagaacauacucugauccacuggcucugcgcgaguuuaaagaguuugcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacacgcuauggaggaacuaccagacaccauagaaacauugaugcuucuagcuuugauagcuguguugacugguggagugacgcuauucuuccuaucaggaaaagguuuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacacgcuacaaugcuggacguagaccuacgcccagcuucagccuggacccucuaugcaguagccacaacaguuaucacucccaugaugagacauacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuagauccugugguuuaugaugcaaaauuugaaaaacagcuaggccaaauaauguuacugauacuuuguacaucacagauccucuugaugcggaccacaugggccuugugugaauccauuacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauacuauugugcugggcugaagaacuuuacugaagugaagggauacacaagcggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucaaaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaagcccagaaucugcacaagagaggaguucacaagaaaaguuaggucaaacgcggcaauaggagcaguguucguugaugaaaaccaauggaacucggcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacucccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggagccuucaaaaggauggaaugauuggcagcaagugccuuucuguucacaccauuuccaccagcugaucaugaaggaugggagggaaauaguggugccaugccgcaaucaagaugaacuugugggcagggccagaguaucgcaaggcgccggauggagccugagagaaacugcuugccuaggcaagucauaugcacaaauguggcagcugauguacuuccacaggagagaccugagacuagcggcuaacgccaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugauccugaaggagcacucugguaa

SEQ ID NO: 5630 - RNA, 9879 nt, Artificial Sequence
  derived and/or modified CDS sequence (wt) from DENV-1__GQ199877__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcugguguaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucaaaaagggaucauuuucaucuugcugaugcuggugacaccaucaauggccaugcgaugugugggaauaggcaacagagacuucguugaaggacugucaggagcaacguggguggacgugguauuggaacauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuuugcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaaguagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauccugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuuggcccaagggaaaaaaaugauuaggccacaaccuauggaacacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacauuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaguucuuuggaggagcuaggggauggacuugcaauggguaucaugauguuaaaauuguugacugaauuucagccacaccaguuauggaccaccuuguugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacauugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggaguaggagucuuccaagacggcguguuccacacaauguggcacguuaccaggggagcuguccuuauguaccaagggaagagacuggaaccaagcugggccagugucaaaaaggacuugaucucauauggaggggguuggagguuccaaggaucauggaacacaggagaagaagugcaggugauagcuguugaaccaggaaaaaaccccaaaaaugugcagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccaggcaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguauuggaggagaacauggacguggagaucuggacaaaggaaggagaaagaaagaaauugcgaccucgcugguuggacgccagaacauacucugauccauuagcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaagagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuacggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacaucuagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaagcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacuuagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggaugucauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacuggcuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaucaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 5631 - RNA, 9879 nt, Artificial Sequence
  derived and/or modified CDS sequence (wt) from DENV-1__GU056029__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcuuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacaaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagagggaaagauaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggacuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuugguccagggaaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaauuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuaguuaggucaaugguuucugcagggucaggagaaguggauaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacagcucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaagcuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugacaauggcaucuauagaaucuugcaaagaggacuguugggcaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaccaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugaccgccauugcaaaucaggcagcuauauugaugggacuugacaagggauggccaauaucgaagauggacauaggaguuccacuucucgccuuagggugcuauucccaggugaacccauugacacugacagcggcgguguugauguuaguagcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauaggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaccacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuucuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5632 - RNA, 9879 nt, Artificial Sequence
  derived and/or modified CDS sequence (wt) from DENV-1__GU056030__SS-prME
uccgugaccaugcuccucaugcugcugcccacagcccuggcguuccauuugaccacacgagggggagagccacacaugauaguuaguaagcaggaaagaggaaagucacucuuguuuaagacuucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggagacuugggcuuugagacacccaggauucacggugauagccuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauacucagugauagucacuguccacacuggggaccagcaccaggugggaaacgagaccacagaacauggaacaauugcaaccauaacaccacaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagauuuaccacugccauggacuucgggggcuucaacaucucaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucagauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaguugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcagacucgggauguguaaucaacuggaagggcagagaacuuaaauguggaaguggcauuuuugucacuaacgaaguucacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcacuuggccgaaaucucacacucuauggagcaauggaguuuuggaaagugaaaugauaaucccaaagauauauggaggaccaauaucucagcacaacuacagaccaggguauuacacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggauguugguauggcauggaaaucagaccaguaaaggagaaggaggagaaucuaguuaggucaauggucucugcagggucaggagaaguggacaauuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagccaaugcuucagacgggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucucugacauuugucaaaacaacucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagcugauuuaucauuggacaaagcggcugaaguauccugggaacaagaagcagaacacuccggugccucacacaacauaucaguagagguccaagaugauggaacuaugaaaauaaaagaugaagagagggaugacacacucaccauacuccuuaaagcaacuuugcuggcaguuucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccugugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaagcggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaauccuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccaggcaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuauaugggacagccuuuaaauaaugaugaggaucacgcucauuggacagaagcaaaaaugcuccuugacaauauaaacacaccagaagggaucaucccagcccuuuuugagccagagagagaaaagagugcagcaauagauggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcccugcgcgaguuuaaagaguuugcagcaggaagaagaagugucucaggugaccuaauacuggaaauagggaaacuuccacaacauuugacgcuaagagcccagaaugcccuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaagguuuagggaaaacauccauuggcuugcucugugugacggccucaagugcacuguuauggauggccaguguggagccccauuggauagcggccuccaucauacuagaguucuuuuugauggugcugcucauuccagagccagacagacagcgcacuccacaggacaaccagcuagcauauguggugauaggcuuguuauucaugauacuuacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaacacaacggcaaacauuucccugacagccauugcaaaucaggcagcuauauugaugggacuugacaagggauggccaauaucgaagauggacauaggaguuccacuucucgccuuagggugcuauucccaggugaacccauugacgcugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccuguggucuaugauguaaaauuugaaaaacagcuaggccaaauaauguuacugauacuuuguacaucacagauccucuugaugcggaccacaugggccuugugugaauccaucacacuggcuacuggaccccugacuacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaucaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggagccuaucccaauggcgaccuauggauggaaccuaguaaagcuacacucuggaaaagauguauuuuucaugccaccugagaaaugugacacccuucugugugauauuggugaguccucuccgaauccaaccauagaagaaggaagaacguuacguguucuaaaaaugguggaaccauggcucagaggaaaccaauucugcauaaaaaucuuaaauccuuacaugccaagugugguagaaacucuugagcaaaugcaaagaaaacauggagggaugcuagugcgaaacccacucucaagaaauucuacccaugaaauguauuggguuucauguggaacaggaaacauugugucggcagugaacaugacauccagaaugcuacugaaccgauucacaauggcucacaggaagccaacauaugaaagagauguggacuuaggcgcuggaacaagacaugugacaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcguacaccaagagcaaaacgaggcacaacacaaauuauggaggugacagccaagugguuaugggguuuccuuuccagaaacaaaaaacccagaaucugcacaagagaggaguucacaagaaaggucaggucaaacgcggcaauaggagcaguguucguugacgaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuuuuggaguucgaagcccuugguuucaugaaugaagaucacugguuuaguagagagaauucacucaguggaguggaaggagaaggacugcacaaacucggauacauacucagagacauaucaaagauuccggggggaaacauguaugcagaugauacagccggaugggacacaagaauaacagaggaugaucuccagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaucugagacuagcagcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5633 - RNA, 9879 nt, Artificial Sequence
  derived and/or modified CDS sequence (wt) from DENV-1__GU056031__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggccuagaaacaagaaccgaaacauggauguccucugaaggcgccuggaaacaaauacaaagaguggaaacuugggcuuugagacacccaggauucacggugauagccuuuuuuuuagcacaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuuggcccaagggaaaaaaaugauuaggccacaacccauggaacacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuuaacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccaucaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacaucuagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacuuagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauucagauuacaugacaucaaugaagagauucaagaaugagagugaucccgaaggagcacucugguaa

SEQ ID NO: 5634 - RNA, 9879 nt, Artificial Sequence
  derived and/or modified CDS sequence (wt) from DENV-1__GU056032__SS-prME
uccguggccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugugucaccaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagccuauugacgugugccaaguucaagugugugacaaaauuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuagucacauuuaagacagcucaugcaaagaaacaggaaguagucguacugggaucacaggaaggagcaaugcauacugcguugacuggggcgacagaaauccagacgucaggaacgacaacaaucuuugcaggacaccugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauucugggagacaccgcaugggacuucggcucuauaggaggaguguucacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcaugguuacgcuauaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaaaagcaugggaggagggcguguguggaauucgaucagccacgcgccuugagaacaucauguggaagcaaauaucaaaugaauugaaccacauucuacuugaaaaugacaugaaauucacagugguuguaggagaugcuaauggaauuuuggcccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacaaacauaugguugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacagucguuguggaugaacauuguggaaaucgagguccuucucucagaacuacaacagucacaggaaagauaauccaugaaugguguugcagauccugcacguuaccccccuuacguuucagaggagaagacggauguugguauggcauggaaaucagaccaguaaaggagaaggaggagaauuuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuccucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuaugguacugucaaucguaucucucuuuccuuuaugccugucuacgaccucccaaaaaacaacauggcuuccggugcuguuaggaucuuuuggaugcaaaccguuaaccauguuucuuauaacagaaaacaaaaucuggggaaggaaaaguuggccccucaaugaaggaauuauggcuguuggaauagucagcaugcuacuaaguucacuccucaaaaaugaugugccgcuggccggcccacuaauagcuggaggcaugcuaauagcauguuaugucauauccggaagcucagccgauuuaucauuggagaaagcggcugagguguccugggaacaagaggcagaacacuccgguaccucacacaacauacuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcgcacguuaaucuuggcccccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugauuauuauggaugaagcacauuucaccgauccagccagcauagcggccagaggguacaucucaacccgaguggguaugggugaagcagcugcgaucuuuaugacagccacucccccaggaucgguggaagccuuuccacagaguaaugcagucauucaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuguccuacaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugccauggaggaacuaccagacaccauagaaacauugaugcuucuagcuuugauagcuguguugacugguggagugacgcuguucuuccuaucaggaaaaggucuagggaaaacauccaucggccugcucugugugacggccucaagcgcacuguuauggauggccaguguggagccccauuggauagcggccuccaucauacuagaguucuuuuugauggugcugcuuauuccagagccagacagacagcgcacuccacaggacaaccagcuagcauauguggugauagguuuguuauucaugauacugacaguggcagccaaugagaugggauuauuggaaaccacaaagaaagaccuggggauuggccauguagcggccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggaguggaauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguuuuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaacauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagccaugaccgauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuagcagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcaacagccuuaacagcccugaaugacaugggaaaaauaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagcuugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccacuaacauacaaguggccauaaaccaagugagaaggcucaucgggaaugagaauuaucuagauuacaugacaucaaugaagagauucaagaaugagagugauaccgaaggggcacucugguaa

SEQ ID NO: 5635 - RNA, 9879 nt, Artificial Sequence
  derived and/or modified CDS sequence (wt) from DENV-1__GU056033__SS-prME
uccgugaccaugcuccucaugcuacugcccacagcccuggcguuccauuugaccacacgagggggagagccacacaugauaguuaguaagcaggagagaggaaagucacucuuguuuaagaccucuguaggugucaacaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugugugggaauaggcaacagagacuucguugaaggacugucaggagcaacguggguggacgugguauuggagcauggaagcugcgucaccaccauggcaaaaaauaaaccaacauuggacauugaacucuuaaagacggaggucacgaacccugccgucuugcgcaaacugugcauugaagccaaaauaucaaacaccaccaccgauucaagauguccaacacaaggagaggcuacacugguggaagaacaagacgcgaacuuugugugucgccgaacguucguggacagaggcugggguaauggcugcggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauuuaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaagggaaugucauaugugaugugcacaggcucauucaagcuagagaaggaaguggcugagacccagcauggaacuguuuuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccauacuuggacagagcaauacaaguuccaggcugacucuccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagauguuaauggaauuuuggcccaaggaaaaaaaaugauuaggccacagcccauggaacacaaauacucauggaaaagcuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgaaagccuccuucauagaagucaagacaugcaucuggccgaaaucccacacucuauggagcaauggaguuuuggaaagugaaaugauaauuccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacgcuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucucauaaugggacaacugacauggaaugaucugauuagguuaugcauuaugguuggagcuaaugcuucagacaggauggggaugggaacaacguaccuagccuugauggccacuuucaaaaugagaccaauguuugcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccacuaaccauguuucuuauaacagaaaacaaaauuuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccgguaccucacacaacauauuaguagagguccaagaugacggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucucgcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauacggaggagguuggagguuucaaggaucauggaacacgggagaagaagugcagguaauagcuguugaaccaggaaaaaaccccaaaaauguacagacaacgccggguaccuucaagacuccugaaggugaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuugacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaauaugauuauuauggaugaagcacauuucaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggaucacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagcuggaccgaugccagugacuguggccagugcugcccagaggagaggaagaauuggaaggaaccaaaacaaggaaggugaucaguaugucuacaugggacagccuuuaaauaaugaugaggaucacgcucacuggacagaagcaaaaaugcuccuugacaauauaaacacaccagaagggaucaucccagcccucuuugagccagagagagaaaagagugcagcaauagacggggaguacagacugcgaggagaagcaaggaaaacauucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaacuccgaacaaggaggaaaagccuauagacaugcuauggaggaacuaccagacacuauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuucugauggugcugcucauuccagagccagacagacagcgcacuccacaggacaaccaguuagcauauguggugauagguuuguuauucaugauacugacaguggcagccaaugagaugggauuauuggaaaccacaaagaaagaccuggggauuggccauguagccgccgaaagccaccaacaugcuacaaugcuggacguagaccuacguccagcuucagccuggacucuuuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacauugacagcggcgguguugauguuaguggcucauuaugccauaauuggaccaggacugcaagcaaaggccacuagagaagcucaaaaaaggacagcggccggaauaaugaaaaauccaaccguagacgggaucguugcaauagacuuggauccugugguuuaugaugcaaaauuugaaaaacagcuaggccaaauaauguuacugauacuuuguacaucacagauccucuugaugcgaaccacaugggccuugugugaauccaucacacuggcuaccggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggaggcaggagagguacgggagcucaaggggaaacacugggagaaaaauggaaaagacaguuaaaccaauugagcaagacagaauucaacaccuacaaaaggagugggauuauggagguggacagauccgaagccaaagagggacugaaaagaggagaaacaacuaaacaugcagugucgagaggaacagccaaacugaggugguuuguggagaggaaccucgugaaaccagaaggaaaagucauagaccucgguuguggaagagguggcuggucauauuauugugcugggcugaagaaagucacugaagugaaaggauacacaaaaggaggacuuggacaugaggaacccaucccaauggcgaccuauggauggaaccuaguaaagcuacacucuggaaaagauguauuuuuuaugccaccugagaaaugugacacccuucugugugauauuggugaguccucuccgaacccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggauuuaggcgcuggaacaagacauguugcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugaaauugcucacaaaaccaugggaugucauccccauggucacacaaauagcuaugacugauaccacacccuuuggacaacagagaguguuuaaagagaaaguugacacgcgcacaccaagagcaaagcgaggcacaacacaaauuauggaggugacagccaagugguuaugggguuuccuuuccagaaacaaaaaacccagaaucugcacaagagaggaguucacaagaaagguuaggucaaacgcagcaauaggagcaguguucguugaugaaaaucaauggaacucagcaaaagaagcaguggaagacgaaagguuuuggaaucucgugcacagagagagggagcuucauaaacagggaaaaugugccacgugugucuacaacaugauggggaagagagagaaaaaguuaggagaguuuggaaaagcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaacauguaugcagaugauacagccggaugggacacaagaauaacagaggaugaucuucagaaugaggcuaaaaucacugacaucauggagccugaacaugcucuauuggcuacgucaauuuuuaagcugacuuaucaaaauaagguggugagggugcaaagaccagcaaaaaauggaaccgugauggauguuauauccagacgugaccagagaggaaguggacaggucggaacauauggcuuaaauacuuucaccaauauggagguccaacuaauaagacaaauggagucugaaggaaucuuuuuacccagcgaacuggaaacccccaaucuagcugagagaguccuugacugguuggaaaaacauggcgccgaaaggcugaaaagaauggcaaucagcggagaugauugcguggugaaaccaauugacgacagguucgcuacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcaacugauguacuuccacaggagagaccugagacuggcggcuaacgcuaucuguucagccgucccaguugauugggucccaaccagccguacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccuaauaggcuugacagcgagggccaccugggccaccaacauacaaguagccauaaaccaagugagaaggcucaucgggaaugagaauuaucuagauuacaugacaucaaugaagagguucaagaaugagagugaucccgaaggggcacucugguaa

SEQ ID NO: 5636 - RNA, 9879 nt, Artificial Sequence
  derived and/or modified CDS sequence (wt) from DENV-1__GU131833__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcugguuacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaggggacgucauacgugaugugcacaggcucauuuaagcuagagaaggaaguggcugagacccagcauggaacuguucuagugcaggucaaauacgaaggaacagacgcgccaugcaagauccccuuuuugacccaagaugagaaaggagugacccagaaugggagauuaauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugggguucuguucagcgguguuucuuggaccaugaaaauaggaauagggauucugcugacaugguugggguuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacuaacauauggcugaaauugcgugacuccuacacccaaaugugugaucaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauugggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauucaucaaaacaacucuuucuuuggauuaugcauggaaaacaacggcuauggcacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauaucuggaagcucagccgauuuaucauuggagaaagcggcugagguguccugggaacaagaagcagaacacuccgguaccucacacaacauauuaguagagguccaagaugacggaacuaugaaaauaaaagaugaagagaaggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggaguuuuccaaaacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagaaauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaaaagugaacacacaggaagggagauaguugaccucaugugccacgccacuuuuaccaugcgucucuuauccccagugagaguucccaacuacaacaugauuauuauggaugaagcacauuucaccgauccagccagcauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugauaauauaaacacaccagaagggaucaucccagcccucuuugagccagagagggaaaagagugcagcaauagacggggaguacagacugcggggagaagcaaggaaaacguucguggagcucaugagaagaggagaucuaccaguuuggcuauccuauaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccauuggcuugcucugcgugacggccucaagcgcacuguuauggauggcuaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggucauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagccauauugaugggacuugacaagggauggccaauaucgaagauggacauaggagucccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcgacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggggagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaaaaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauucuaaauccuuacaugccaagugugguagaaacucuggagcaaaugcaaagaaaacauggagggaugcuagugcgaaacccacuuucaagaaacuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugacgaggacaauccauacaaaacaugggcuuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaggugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucauaaaugaagaucacugguuuaguagagagaauucacucaguggaguggaaggagaaggacugcacaaacuuggauacauacucagagacauaucaaagauuccggggggaaacauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggaugucauauccagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaacauggucaauccaugcccaccaccaauggaugacaacagaagacauguuaucaguguggaauaggguuuggauagaggaaaacccauggauggaggacaaaacucauguauccaguugggaggaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuauauggcaucaaugaagagauucaagaaugagagugaucccgaaggggcacucugguaa

SEQ ID NO: 5637 - RNA, 9879 nt, Artificial Sequence
  derived and/or modified CDS sequence (wt) from DENV-1__GU131834__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaggggaugucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaaacuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucucugacauuugucaaaacaacucucucauuggauuaugcauggaaaacaacggcuaugguacugucuaucgugucucucuuuccuuuaugccugucuacgaccucccaaaaaacaacauggcuuccggugcuguuaggaucuuuuggaugcaaaccauuaaccauguuuuuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcccugcgcgaguuuaaagaguuugcagcaggaagaagaaguguuucaggugaccugauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaaguuacacucuggaaaagauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuagaguucgaagcccuugguuucaugaaugaagaucacugguuuaguagagagaauucacucaguggaguggaaggagaaggacugcacaaacuuggauacauacucagagacauaucaaagauuccggggggaaauauguacgcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggagcacuuugguaa

SEQ ID NO: 5638 - RNA, 9879 nt, Artificial Sequence
  derived and/or modified CDS sequence (wt) from DENV-1__GU131835__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucaucgcgauggacuugggagaguuaugugaggacacaaugaccuacaaauguccccggaucacugaggcggaaccagaugacguugacugcuggugcaaugccacagacacaugggugaccuaugggacguguucucaaaccggcgaacacagacgagacaaacguuccguggcacuggccccacacgugggacuuggucuagaaacaagaaccgaaacauggauguccucugaaggcgccuggaaacaaauacaaagaguggagacuuggguuuugagacacccaggauucacggugauagccuuuuuuuuagcacaugccauaggaacauccaucacucagaaagggauuauuuucauuuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggagguuacgaacccugccgucuugcgcaaacugugcauugaagcuaaaauaucaaacaccaccaccgauucaagauguccaacacaaggagaggcuacacuggcggaagaacaagacgcgaacuuugugugucgccgaacguuuguggacagagguugggguaauggcugcggacuauucggaaagggaagccuauugacgugugccaaguucaagugcgugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacggggcuggauuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuuugcaggacaccugaaaugcagacuaaaaauggauaaacugacuuuaaaggggacgucauaugugaugugcacaggcucauucaagcuagagaaggaaguggcugagacccagcauggaacuguucuagugcaggucaaauacgaaggaacagacgcgccaugcaagauucccuuuucgacccaagaugagaaaggagugacccagaaugggagacugauaacagccaaucccauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaaggauggccauccuaggagacaccgcaugggacuucggcucuauaggaggaguguucacaucugugggaaaauugguacaccagguauuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggggucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgccuugagaacaucauguggaagcaaauaucaaaugaacugaaccacauucuacuugaaaaugacaugaaauucacagugguuguaggagacgcuaauggaauuuuggcccaaggaaaaaaaaugauuaggccacaacccauggaacacaaauacucauggaaaagcuggggaaaagcuaaaaucauaggagcagacauacaaaauaccaccuucaucaucgacggcccagauaccccagaaugccccgaugaccaaagagcauggaacaucugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacauguaccuggccgaaaucccacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuucuccuucuuauaaugggacaauugacauggaaugaucugauuagguuaugcaucaugguuggagcuaaugccucagacaggauggggaugggaacaacauaccuagccuugauggcuacuuucaaaaugagaccaauguucgcuguugggcuauuauuucgcagacuaacauccagagaaguucuucuucucacgauuggauuaagccugguggcauccguggagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggccaugguacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcaugcuaugucauauccggaagcucagccgauuuaucauuggagaaagcggcugagguguccugggaacaagaagcagaacacuccgguaccucacacaacauauuaguggagguccaagacgauggaacuaugaaaauaaaagaugaagagagggaugacacacucaccauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguagaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggaggcuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccaugaaaaggaaacugcguacguuaaucuuggcucccacaagaguugucgccucugaaauggcagaggcgcucaagggaaugccaauaagauaccagacaacagcagugaagagugaacacacaggaagggagauaguugaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcggcugcgaucuuuaugacagccacucccccaggaucgguggaggccuuuccacagagcaaugcaguuauccaagaugaggaaagagacauuccugagagaucauggaacucaggcuacgaguggaucacugauuuuccaggcaaaacagucugguuuguuccaagcaucaaaucaggaaaugacauugccaacuguuuaagaaagaauggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccucuuugagccagagagagaaaagagugcagcaauagauggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguucaaagaguuugcagcaggaagaagaagugucucaggugaucuaauauuggaaauagggaaacuuccacaacacuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugaugcuguucuuccuaucaggaaaaggucuagggaaaacauccauuggcuugcucugugugacggccucaagcgcacuguuauggauggccaguguggagccccauuggauagcggccuccaucguacuagaguucuuuuugauggugcugcucauuccagagccagacagacagcgcacuccacaggacaaccagcuagcauauguagugauagguuuguuauucaugauacugacaguggcagccaaugagaugggauuauuggaaaccacaaagaaagaccuggggauuggccaugcagccgccgaaaaccaccaacaugcuacaaugcuggacguagaccuacguccagcuucagccuggacucucuaugcaguagcuacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccgaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuuuucauuaaugaaaucuuuaggaggagguaggagagguacgggagcucaaggggaaacacugggagagaaauggaaaagacaguuaaaccaacugagcaagccagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagaggugguuggucauauuauugugccgggcugaagaaagucaccgaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguccuaaagaugguggaaccauggcucagaggaaaccaauucugcauaaaaauccuaaauccuuacaugccaacugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaucgauucacaauggcucacaggaagccaacauaugaaagagacguggacuuaggcgcuggaacaagacacguggcaguggaaccagagguagccaaccuagauaucauuggccagaggauagagaauauaaaaaaugaacacaagucaacauggcauuaugaugaggacaauccauacaaaacaugggccuaccauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuucuuuccagaaacaaaaaacccagaaucugcacaagagaagaguucacaagaaagguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacgugcgucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaagggcugcacaaacuuggauacauacucagagacauaucaaggauuccggggggaaauauguaugcagaugauacagccggaugggacacaagaauaacagaggaugaucuucagaaugaggcuaaaaucacugacaucauggagccugagcaugcucuauuggccacgucaauuuuuaagcugacuuaucaaaacaagguggugagggugcaaagaccagcaaaaaauggaaccgugauggauguuauauccagacgugaccagagaggaagcggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcgugguaaaaccaauugacgacagguucgcaacauccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugccugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacuacagaagacauguuaucaguguggaauaggguuuggauagaggaaaacccauggauggaggacaaaacucauguauccaguugggaagaaguuccauaccuagggaaaagggaagaccaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucucgaaggggcacucugguaa

SEQ ID NO: 5639 - RNA, 9879 nt, Artificial Sequence
  derived and/or modified CDS sequence (wt) from DENV-1__GU131836__SS-prME
uccgugaccaugcuccucaugcugcugccuacagcccuggcguuccauuugaccacacgaggaggagagccacacaugauaguuaguaagcaggaaagaggaaagucacucuuguuuaagaccucugcaggugucaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuggaaacaagaaccgaaacauggaugucuucugaaggcgccuggaaacaaauacaaagaguggagacuugggcuuugagacacccaggauucacggugauagcccuuuuuuuagcacaugccauaggaacauccaucacucagaaagggaucauuuucauuuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacuuuggacauugaacucuugaagacggaggucacgaacccugccguuuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggaugcggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggccucaacaucccaagagaccuggaacagacaagauuuacuggucacauucaagacagcucaugcaaagaaacaggaaguagucguacugggaucacaggaaggagcaaugcacacugcauugacuggggcgacagaaauccagacgucaggaacgacaacaaucuuugcaggacaccugaaaugcagacuaaaaauggauaaacugacuuuaaaggggacgucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggugaaaaagcucugaaacuaagcugguucaagaaaggaagcagcauagggaaaauguucgaagcaaccgcccgaggagcacgaaggauggcuauccugggagacaccgcaugggacuucggcucuauaggaggaguguucacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacucaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaauggaauuuugguccaagggaaaaaaaugauuaggccacaacccauggaacacaaauacucauggaaaagcuggggaaaagcuaaaaucauaggagcagacauacaaaauaccaccuucaucaucgacggcccagauaccccagaaugccccgaugaccaaagagcguggaacauuugggaaguugaggacuauggguuuggaauuuucacgacuaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcugucgagagccuccuucauagaagucaagacaugcaccuggccaaaaucucacacucuauggagcaauggaguuuuggaaagugaaaugauaaucccaaagauauauggagggccaauaucucagcacaacuacagaccaggguauuucacacaaacagcagggccauggcaccuaggcaaguuggaauuggauuuugacuugugugaagguaccacaguuguuguggaugaacauuguggaaaucgagguccaucucucagaacuacaacagucacaggaaagauaauccaugaaugguguugcagauccugcacguuaccacccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuucgcagacuaacauccagagaaguucuucuucucacgauuggauuaagcuugguggcauccguggagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccgguaccucacacaacauauuaguagagguccaagaugauggaacuaugaaaauaaaagaugaagagaaggaugauacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaagaauguacagacaacgccggguaccuucaagacuccugaaggcgaaguuggagccauagcucuagauuuuaaacccggcacaucuggaucucccaucgugaacagagagggaaaaauaguuggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccggccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguugaccucaugugccacgccacuuuuaccaugcgucucuuauccccagugagaguucccaauuacaacaugaucauuauggaugaagcacauuuuaccgauccagccaguauagcggccagaggguacaucucaacccgaguggguaugggugaagcagcugcgaucuuuaugacagccacucccccaggaucgguagaggccuuuccacagagcaaugcaguuauccaagaugaggaaagagacauuccugagagaucauggaacucaggcuacgacuggauuacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggcugacaggguaauagacccaaggcggugcuugaaaccgguaauacuaaaagaugguccagagcgugucauucuagccggaccgaugccagugacuguggccagugcagcccagaggagaggaagaauuggaaggaaccaaaacaaggaaggugaccaguauguuuacaugggacagccuuuaaauaaugaugaggaucaugcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaaggagugucucaggugaccuaauauuggaaauagggaaacuuccacaacauuugacgcugagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugauggccucaagcgcacugcuauggauggccaguguggagccccauuggauagcggccuccaucauacuagaauucuuuuugauggugcugcucauuccagagccagacagacaacguacuccacaggacaaccagcuagcauauguggugauagguuuguuauucaugauacugacaguggcagccaaugagaugggauuauuggaaaccacaaagaaagaccuggggauuggccauguagccgccgaaaaccaccaacaugccacaaugcuggacguagaccuacguccagcuucagccuggacucucuaugcaguagccacaacaguuaucacucccaugaugagacacacaauugaaaauacaacggcaaacauuucccugacagccauugcaaaccaggcagcuauauugaugggacuugacaagggauggccaauaucgaagauggacauaggaguuccacuucucgccuuagggugcuauucccaggugaacccauuaacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaauguuacugauacuuuguacaucacagauccuccugaugcggaccacaugggccuugugugaauccaucacacuggcgacuggaccccugaccacucucugggagggaucuccagguaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacacgcagugucgagaggaacagccaaacugaggugguuuguggagaggaaccucgugaaaccagaagggaaagucauagaccucgguuguggaagagguggcuggucauauuauugugcuggguugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguugcguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacacguggcaguggaaccagaggugcccaaccuagauaucauuggucagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggucacagccaagugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccuggacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaacacuuucacuaauauggagguccaacugauaagacaaauggagucugaaggaaucuuuuugcccagcgaauuggaaacccccaaucuagcugagagaguucucgacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagagugucacaaggcgccggauggagucugagagaaacugcuugccuagguaagucauaugcacaaauguggcagcugauguacuuccacaggagagaccugagacuagcggcuaacgcuaucuguucagccgucccaguugauugggucccaaccagccgcacaaccuggucaauccaugcccaccaucaauggaugacaacagaagacauguuaucaguguggaauaggguuuggauagaggaaaacccauggauggaggacaaaacucauguauccaguugggaagaagucccauaccuagggaaaagggaagaucaaugguguggaucccugauagguuugacagcaagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5640 - RNA, 9879 nt, Artificial Sequence
  derived and/or modified CDS sequence (wt) from DENV-1__GU131837__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagauaaacguuccguggcacuggccccacacgugggacuuggucuagaaacaagaaccgaaacauggauguccucugaaggcgccuggaaacaaauacaaagaguggagacuugggcuuugagacacccaggauucacggugauagcccuuuuuuuagcacaugcuauaggaacauccaucacucagaaagggaucauuuucaucuugcugaugcuggugacaccaucaauggcuaugcgaugugugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaauccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuugaaauauucagugauagucacuguccacacuggggaccagcaccaggugggaaacgagaccacagaacauggaacaauugcaaccauaacaccucaagcuccuacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugacuuuaaaagggaugucauaugugaugugcacaggcucauuuaagcuagagaaggaaguggcugagacccagcauggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagaaaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugcuaacggaauuuuggcccaagggaaaaaaaugauuaggccacaacccauggaacacaaauacucauggaaaagcuggggaaaagcuaaaaucauaggagcagacauacaaaauaccaccuucaucaucgacggcccagacaccccagaaugucccgauggccaaagagcauggaacauuugggaaguugaggacuauggguuuggaauuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucaauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuacugucucugacauuugucaaaacaacucuuucauuggauuaugcauggaaaacaacggcuaugguacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcaggucccaaguaggagugggagucuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuucaaacccggcacaucuggaucucccauugugaacagagagggaaaaauagugggucuuuauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucaggaaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuaccuuuaccaugcgucucuuauccccagugagaguucccaauuacaacaugauuauuauggaugaagcacauuuuaccgauccagccagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugauuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuugaauaaugaugaggaucacgcucauuggacagaagcaaaaaugcuccuugacaauauaaacacaccagaagggaucaucccagcccucuuugagccagagagagaaaagagugcagcgauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggacaacuuggucauguugcacaacuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacaucuauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacgcccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagaugggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagaggaagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacaaauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucucgugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacucggauacauacucagagacauaucaaagauuccggggggaaauauguaugcagaugauacagccggaugggacacaagaauaacagaggaugaucuucagaaugaggcuaaaaucaccgacaucauggagccugaacaugcucuauuggcuacgucaauuuuuaagcugacuuaucaaaacaagguggugagggugcaaagaccagcaaaaaauggaaccgugauggauguuauauccagacgugaccagagaggaaguggacaggucggaacuuauggcuuaaauacuuucaccaauauggagguccaacuaauaagacaaauggagucugaaggaaucuuuuuacccagcgaauuggaaacccccaaccuagcugagagaguucuugacugguuggaaaaacauggcaccgaaaggcugaaacggauggcaaucagcggagaugauugcguggugaaaccaauugacgacagguucgcaacagccuuaacagcucugaaugacaugggaaaaguaagaaaagacauaccacagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauagguuugacagcgagggccaccugggccaccaacauacaaguagccauaaaccaagugagaaggcucaucgggaaugagaauuaucuagauuacaugacaucaaugaagagauucaagaaugagagugaucccgaaggagcacucugguaa

SEQ ID NO: 5641 - RNA, 9879 nt, Artificial Sequence
  derived and/or modified CDS sequence (wt) from DENV-1__JN819415__SS-prME
uccgugaccaugcuccucaugcugcugcccacagcccuggcguuccauuugaccacacgagggggagagccacacaugauaguuaguaagcaggaaagaggaaagucacucuuguuuaagaccucugcaggugucaauaugugcacucucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccguggcacuggccccacacgugggacuuggucuagaaacaagaaccgaaacauggauguccucugaaggcgccuggaaacaaauacaaagaguggagacuugggcuuugagacacccaggauucacggugacagcccuuuuuuuagcacaugccauaggaacauccaucacucagaaagggaucauuuucauuuugcuaaugcuggugacaccaucaauggccaugcgaugcgugggaauagguaacagagacuucguugaaggacugucaggagcaacguggguggacgugguauuggagcauggaagcugcgucaccaccauggcaaaaaauaaaccaaccuuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagccuauugacgugugccaaguucaagugugugacaaaacuagaaggaaagauaguucaauaugaaaacuuaaaauauucagugauagucacuguccacacuggggaccagcaccaggugggaaacgagacuacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccuuggacuucgggggcuucaacaucccaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuuugcaggacaccugaaaugcagacuaaaaauggauaaacugacuuuaaaggggacgucauaugugaugugcacaggcucauuuaagcuagagaaggaaguggcugagacccaacauggaacuguucuagugcaggucaaauacgaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcuggugaaaaagcuuugaaacuaagcugguucaagaaaggaagcagcauagggaaaauguucgaagcaacugcccgaggagcacgaaggauggcuauccugggagacaccgcaugggacuucggcucuauaggaggaguguucacaucuguaggaaaauugguacaccagguuuuuggaaccgcauaugggguucuguucagcgguguuucuuggaccaugaaaauaggaauagggauucugcugacaugguugggauuaaauucaaggagcacgucacuuucgaugacgugcauugcaguuggcaugguuacacuguaccuaggagucaugguucaagcggacucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugaaaaugacaugaaauucacagugguuguaggagaugccaauggaauuuuggcccaaggaaaaaaaaugauuaggccacaacccauggaacacaaauacucauggaaaagcuggggaaaagcuaaaaucauaggagcagacauacaaaauaccaccuucaucauagacggcccagauaccccagaaugccccgaugaccaaagagcguggaacauuugggaaguugaggacuauggguuuggaauuuucacgacuaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuaggcaaguuggaauuggauuuuaacuugugugaagguaccacaguuguuguggaugaacauuguggaaaucgagguccaucucucagaacuacaacagucacaggaaagauaauccaugaaugguguugcagauccugcacguuaccccccuuacguuucagaggagaagacggauguugguauggcauggaaaucagaccaguaaaggagaaggaggagaaucuaguuaggucgauggucucugcagggucaggagaaguggacaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuguuucgcagacuaacauccagagaaguucuucuucucacgauuggauuaagccugguggcauccguagagcuaccaaauucuuuggaggagcuaggggauggacuugcaauggguaucaugauguuaaaauuauugacugaauuucagccacaccaguuauggaccaccuuacugucucugacauuuaucaaaacaacucuuucauuggauuaugcauggaaaacaacggcuauggcacugucaaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacugaguucacuccucaaaaaugaugugccguuggccggcccacuaauagcuggaggcaugcuaauagcauguuaugucauauccggaagcucagccgauuuaucauuggagaaagcggcugagguguccugggaacaagaagcagaacacucagguaccucacacaacauauuaguagagguccaagaugauggaacuaugaaaauaaaagaugaagagaaggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguugggcagaucccaagugggagugggaguuuuccaagacggcguguuccacacaauguggcacgucaccaggggagcuguccuuauguaccaagggaagaggcuggaaccaagcugggccagugucaaaaaggacuugaucucauauggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacaucuggaucucccaucgugaacagagagggaaaaauaguaggucuuuauggaaauggaguggugacaacaaguggaaccuacgucagugccauugcucaagcuaaagcaucacaggaagggccucuaccagagauugaggacgagguguuuaagaaaagaaacuuaacaauaauggaccugcauccaggaucaggaaaaacaagaagauaucuuccagccauaguccgugaggccauaaaaaggaaacugcguacguuaaucuuggcucccacaagaguugucgccucugaaauggcagaggcgcucaagggaaugccaauaagauaucagacaacagcagugaagagugaacacacaggaagggagauaguagaccucaugugccacgccacuuuuaccaugcgucucuuauccccagugagaguucccaauuacaacaugauuauuauggaugaagcacauuuuaccgauccagccagcauagcggccagaggguacaucucaacccgaguggguaugggugaagcagcugcaaucuuuaugacagccacucccccaggaucgguagaggccuuuccacagagcaaugcaguuauccaagaugaggaaagagacauuccugagagaucauggaacucaggcuacgacuggaucacugauuuuccagguaaaacagucugguuugucccaagcauuaaaucaggaaaugacauugccaacuguuuaagaaagaacggaaaacggguaauccaauugagcagaaaaaccuuugacacugaguaccagaaaacaaaaaacaaugauugggacuauguugucacaacagacauuuccgaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaacgaugaggaucacgcucauuggacagaagcaaaaaugcuccuugacaauauaaacacaccagaagggaucaucccagcccucuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccccgcugguuggaugccagaacauacucugauccacuggcccugcgcgaguuuaaagaguuugcagcaggaagaagaagugucucaggugaccuaauauuggaaauagggaaacuuccacaacauuugacgcuaagagcccagaaugcucuggauaacuuggucauguugcacaauuccgaacaaggaggaaaagccuauagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuucuugauggugcugcucauuccagagccagacagacagcgcacuccacaggacaaccagcuagcauauguggugauagguuuguuauucaugauacugacaguggcagccaaugagaugggauuauuggaaaccacaaagagagaccuggggauuggccauguagccgccgaaaaccaccaacaugcuacaaugcuggacguagaccuacguccagcuucagccuggacucucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaacuguagacgggauuguugcaauagacuuggauccugugguuuaugaugcaaaauuugaaaaacagcuaggccaaauaaugcuacugauacuuuguacaucacagauccucuugaugcggaccacaugggccuugugugaauccaucacacuggcgacuggaccccugaccacucucugggagggaucuccaggaaaauucuggaauaccacgauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacuaaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaagucacugaagugaagggauacacaaaaggaggaccuggacaugaggaaccuaucccaauggcgaccuauggauggaaccuaguaaagcuacacucuggaaaagauguauuuuuuaugccaccugagaaaugugacacccuuuugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaauauugugucggcagugaacaugacauccagaauguuacugaaucgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuaugguaaauggaguggugagauugcucacaaaaccaugggauguuauccccauggucacacaaauagcuaugaccgauaccacacccuuuggacaacagagaguguuuaaagagaaaguugacacgcgcacaccaagagcaaaacgaggcacaacacaaauuauggaggugacagccaagugguugugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaacuaggagaguuuggaaaggcaaaaggaagccgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccagggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauaucuagacgugaccagagaggaaguggacaggucggaacuuauggcuuaaauacuuucacuaauauggagguccaacuaauaagacaaauggagucugaaggaaucuuuuuacccagcgaauuggaaacccccaaucuagcugagagaguucuugacugguuggaaaaacauggcgccgaaaggcugaaaagaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuucuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauucaugcccaccaccaauggaugacaacagaagacauguuaucaguguggaauaggguuuggauagaggaaaacccauggauggaggacaaaacucauguauccaguugggaagaaguuccauaccuagggaaaagggaagaucaaugguguggaucccugauaggcuugacagcgagggccaccugggccaccaacauacaaguagccauaaaccaagugagaaggcucaucgggaaugagaauuaucuagauuacaugacaucaaugaagagauucaagaaugagagugaucccgaaggggcacucugguaa

SEQ ID NO: 5642 - RNA, 9879 nt, Artificial Sequence
  derived and/or modified CDS sequence (wt) from DENV-1__GU131838__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcuuuuuuuuuagcacaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcuguggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuucucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuuggcccaaggaaaaaaaaugauuaggccacaacccauggaacacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaaacggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauuuuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuagacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacauugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacucagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacugguuagaaaaacauggcgccgaaaggcugaaacgaauggcaaucagcggagaugauugcguggugaaaccaauugacgauagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 5643 - RNA, 9879 nt, Artificial Sequence
  derived and/or modified CDS sequence (wt) from DENV-1__GU131839__SS-prME
uccgugaccaugcuccucaugcugcugcccacagcccuggcguuucauuugaccacacgagggggagagccacacaugauaguuaguaagcaggaaagaggaaagucacucuuguuuaagaccucugcgggcgucaauaugugcacccucauugcgauggacuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagcuuuuuuuuuagcacaugcuauaggaacauccaucacucagaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugccgucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcuggggcaauggcugcggacuauucggaaagggaagucuauugacgugugccaaguucaagugugugacaaaacuagaaggaaagacaguucaauaugaaaaccuaaaauauucagugauagucacuguccacacuggggaccagcaccaggugggaaacgagaccacagaacauggaacaauugcaaccauaacaccucaagcucccacgucggaaauacagcugaccgacuauggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacugcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuugguccagggaaaaaaaaugauuaggccacaacccauggaacacaaauacucauggaaaagcuggggaaaagcuaaaaucauaggagcagacacacaaaauaccaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggacuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuaguuaggucaauggucucugcagggucaggagaaguggauaguuuuucauuaggaauacuaugcguaucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacgauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacagcucucucauuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaagcuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuuguuggcagucucaggaguguacccaaugucaauaccagcaacucuuuuugugugguauuuuuggcagaaaaagaaacagagaucaggaguguuaugggacacacccagcccuccggaaguggaaagagcaguucuugacaauggcaucuauagaaucuugcaaagaggacuguugggcaggucccaaguaggagugggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacgggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcaucaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggccuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuguuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugaccgccauugcaaaucaggcagcuauauugaugggacuugacaagggauggccaauaucgaagauggacauaggaguuccacuucucgccuuagggugcuauucccaggugaacccauugacacugacaucggcgguguugauguuaguagcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaaggaaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauaggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuagagagaaaguugacacgcgcacaccaagagcaaaacgaggcacaacacagauuauggaggugacagccaagugguuaugggguuuucuuuccagaaacaaaaaacccagaaucugcacaagagaggaguucacaagaaagguuaggucaaacgcggcaauaggagcaguguucguugaugaaaaccaauggaacucagcaaaagaagcaguggaagacgaaagguucugggaucuugugcacagagagagggagcuucauaaacagggaaaaugugccacgugugucuacaacaugauggggaagagagagaaaaaauuaggagaguuuggaaaggcaaaaggaagucgugcaauaugguacauguggcugggagcacgcuuucuggaguucgaagcccuugguuucaugaaugaagaccacugguuuaguagagagaauucacucaguggaguggaaggagaaggacugcacaaacuuggauacauacucagagacauaucaaagauuccggggggaaauguguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggauguuauauccagacgugaucagagaggaaguggacaggucggaacuuauggcuuaaauacuuucaccaauauggagguccaacuaauaagacaaauggagucugaaggaaucuuucuacccagcgaauuggaaacccccaaccuagcugagagggcucuugacugguuagaaaaacauggcgucgaaaggcugaaacgaauggcaaucagcggagaugauugcguggugaaaccaauugacgacagguucgcaacagccuuaacagcucugaaugacaugggaaaagugagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuagcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaucaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugauuccgaaggagcacucugguaa

SEQ ID NO: 5644 - RNA, 9879 nt, Artificial Sequence
  derived and/or modified CDS sequence (wt) from DENV-1__GU131841__SS-prME
uccgugaccaugcuccucaugcugcugcccacagcccuggcguuucauuugaccacacgagggggagagccacacaugauaguuaguaagcaggaaagaggaaagucacucuuguuuaagaccucugugggcgucaauaugugcacccucauugcgauggacuugggagaguuaugugaggacacaaugaccuacaaaugcccccggaucacugaggcggaaccagaugacguugacugcugguguaaugccacagacacaugggugaccuaugggacguguucucaaaccggcgaacaccgacgagagaaacguuccguggcacuggccccacacgugggacuuggucuagaaacaagaaccgaaacauggauguccucugaaggcgccuggaaacaaauacaaagaguggaaacuugggcuuugagacacccaggauucacggugauagccuuuuuuuuagcauaugcuauaggaacauccaucacucaaaaagggaucauuuucaucuugcugaugcuggugacaccaucaauggccaugcgaugcgugggaauaggcaacagagacuucguugaaggacugucaggagcaacguggguggacgugguauuggagcauggaagcugcgucaccaccauggcaaaaaauaaaccaacauuggacauugaacucuugaagacggaggucacgaacccugcugucuugcgcaaacugugcauugaagcuaaaauaucaaacaccaccaccgauucaagauguccaacacaaggagaggcuacacugguggaagaacaagacgcgaacuuugugugucgccgaacguuuguggacagaggcugggguaauggcugcggacuauucggaaagggaagucuauugacgugugccaaguucaagugugugacaaaacuagaaggaaagauaguucaauaugaaaacuuaaaauauucagugauagucacuguccacacuggggaccagcaccaggugggaaacgagaccacagaacauggaacaauugcaaccauaacaccucaagcucccacgucggaaauacagcugaccgacuacggagcccucacauuggacugcucaccuagaacagggcuggacuuuaaugagauggugcuauugacaaugaaagaaaaaucauggcuuguccacaaacaaugguuucuagacuuaccacugccauggacuucgggggcuucaacaucucaagagaccuggaacagacaagauuugcuggucacauucaagacagcucaugcaaagaaacaggaaguagucguacugggaucacaggaaggagcaaugcacacagcguugacuggggcgacagaaauccagacgucaggaacgacaacaaucuucgcaggacaccugaaaugcagacuaaaaauggauaaacugaccuuaaaggggaugucauaugugaugugcacaggcucauuuaagcuagagaaggaaguggcugagacccagcauggaacuguucuagugcaggucaaauaugaaggaacagacgcgccaugcaagauccccuuuucgacccaagaugagaaaggagugacccagaaugggagauugauaacagccaaucccauaguuacugacaaagaaaaaccagucaacauugagacagaaccaccuuuuggugagagcuacaucgugguaggggcaggcgaaaaagcuuugaaacuaagcugguucaagagaggaagcagcauagggaaaauguucgaagcaaccgcccgaggagcacgaaggauggcuauccugggagacaccgcaugggacuucgguucuauaggaggaguguuuacaucugugggaaaauugguacaccagguuuuuggaaccgcauaugggguucuguuuagcgguguuucuuggaccaugaaaauaggaauagggauucugcugacaugguugggauuaaauucaaggagcacgucacuuucgaugacgugcauugcaguuggcauggucacacuguaccuaggagucaugguucaagcggauucgggauguguaaucaacuggaagggcagagaacuuaaauguggaaguggcauuuuugucacuaaugaaguccacacuuggacagagcaauacaaauuccaggcugacuccccaaaaagacugucagcagccauuggaaaggcaugggaggagggcguguguggaauucgaucagccacgcgucuugagaacaucauguggaagcaaauaucaaaugaauugaaccacauucuacuugagaaugacaugaaauucacagugguuguaggagaugccaacggaauuuuggcccaagggaaaaaaaugauuaggccacaaccuauggagcacaaauacucauggaaaagcuggggaaaagcuaaaaucauaggagcagacauacaaaauacuaccuucaucaucgacggcccagacaccccagaaugucccgauggccaaagagcauggaacauuugggaaguugaggacuauggguuuggaguuuucacgacaaacauauggcugaaauugcgugacuccuacacccaaaugugugaccaccggcuaaugucagcugccaucaaggacagcaaggcaguccaugcugacaugggguacuggauagaaagugaaaagaacgaaaccuggaagcuggcgagagccuccuucauagaagucaagacaugcaccuggccgaaaucucacacucuauggagcaauggaguuuuggaaagugaaaugauaaucccaaagauauauggaggaccaauaucucagcacaacuacagaccaggguauuucacacaaacagcagggccauggcaccuagguaaguuggaacuggauuuugacuugugugaagguaccacaguuguuguggaugaacauuguggaaaucgagguccaucucucagaaccacaacagucacaggaaagauaauccaugaaugguguugcagauccugcacgcuaccccccuuacguuucagaggagaagacggguguugguauggcauggaaaucagaccaguaaaggagaaggaggagaaucuagucaggucaauggucucugcagggucaggagaaguggauaguuuuucauuaggaauacuaugcgugucaauaaugauugaagaagugaugagauccagauggaguagaaagaugcugaugacuggaacacuggcuguuuuccuccuucuuauaaugggacaacugacauggaaugaucugauuagguuaugcaucaugguuggagcuaaugcuucagacaggauggggaugggaacaacguaccuagccuugauggcuacuuucaaaaugagaccaauguucgcuguugggcuauuauuccgcagacuaacauccagagaaguucuucuccucacuauuggauuaagccugguggcauccguggagcuaccaaauucuuuggaggagcuaggggauggacuugcaauggguaucaugauguuaaaauuguugacugaauuucagccacaccaguuauggaccaccuuauugucucugacauuugucaaaacaacucucucacuggauuaugcauggaaaacaacggcuaugguacugucuaucguaucucucuuuccuuuaugccugucuacgaccucccaaaaaacaacauggcuuccggugcuguuaggaucuuuuggaugcaaaccauuaaccauguuucuuauaacagaaaacaaaaucuggggaaggaaaaguuggccccucaaugaaggaauuauggcuauuggaauagucagcauucuacuaagcucacuccucaaaaaugaugugccguuggccgggccacuaauagcuggaggcaugcuaauagcauguuaugucauauccggaagcucagccgauuuaucauuggagaaagcggcugaaguauccugggaacaagaagcagaacacuccggugccucacacaacauauuaguagagguccaagaugauggaacuaugaaaauaaaagaugaagagagggaugacacacucacuauacuccuuaaagcaacuuugcuggcagucucaggaguguacccaaugucaauaccagcaacucuuuuugugugguauuuuuggcagaaaaagaaacagagaucaggaguguuaugggacacacccagcccuccggaaguggaaagagcaguucuugaugauggcaucuauagaaucuugcaaagaggacuguuggggaggucccaaguaggaguaggagucuuccaagacggcguguuccacacaauguggcacguuaccaggggagcuguccuuauguaccaagggaagagacuggaaccaagcugggccagugucaaaaaggacuugaucucauauggaggagguuggagguuccaaggaucauggaacacaggagaagaagugcaggugauagcuguugaaccaggaaaaaaccccaaaaauguacagacaacgccgggcaccuucaagacuccugaaggcgaaguuggagccauagcucuagauuucaaacccggcacaucuggaucucccauugugaacagagagggaaaaauagugggucuguauggaaauggaguggugacaacaaguggaaccuacgucagugccauugcccaagcuaaagcaucacaggaagggccucuaccagagauugaggacgagguguuuaagaaaagaaacuuaacaauaauggaccugcacccaggaucagggaaaacaagaagauaucuuccagccauaguccgugaggccauaaaaaggaaacugcguacguuaaucuuggcucccacaagaguugucgccucugaaauggcagaggcacucaagggaaugccaauaagauaucagacaacagcagugaagagugaacacacaggaagggagauaguugaccucaugugccacgcuacuuuuaccaugcgucucuuauccccagugagaguucccaauuacaacaugauuauuauggaugaagcacauuuuaccgauccagcuagcauagcggccagaggguacaucucaacccgaguggguaugggugaagcagcugcgaucuuuaugacagccacucccccaggaucgguggaggccuuuccacagagcaaugcaguuauccaagaugaggaaagagacauuccugagagaucauggaacucaggcuacgacuggauuacugacuuuccagguaaaacagucugguuuguuccaagcauuaaaucaggaaaugacauugccaacuguuuaagaaagaacggaaaacggguaauccaauugagcagaaaaaccuuugacacugaguaccagaaaacaaaaaacaaugacugggacuauguugucacaacagacauuucugaaaugggggcaaauuuccgggccgacaggguaauagacccaaggcggugcuugaaaccgguaauacuaaaagaugguccagagcgugucauucuagccggaccgaugccagugacuguggccagugcugcccagaggagaggaagaauuggaaggaaccaaaacaaggaaggugaucaguauguuuacaugggacagccuuuaaauaaugaugaggaucacgcucauuggacagaagcaaaaaugcuccuugacaauauaaacacaccagaagggaucaucccagcccuuuuugagccagagagagaaaagagugcagcaauagacggggaguacagacugcggggagaagcaaggaaaacguucguggagcucaugagaagaggagaucuaccaguuuggcuauccuacaaaguagccucagaagguuuccaguacuccgacagaagguggugcuuugauggggaaaggaacaaccagguguuggaggagaacauggacguggagaucuggacaaaggaaggagaaagaaagaaauugcgaccucgcugguuggacgccagaacauacucugauccauuggcccugcgcgaguuuaaagaguucgcagcaggaagaagaagugucucaggugaccuaauauuggaaauagggaaacuuccacaacauuugacgcuaagagcccagaaugcucuggacaacuuggucauguugcacaauuccgaacaaggaggaaaagccuacagacaugcuauggaggaacuaccagacaccauagaaacauugaugcuucuagcuuugauagcuguguugacugguggagugacgcuguucuuccuaucaggaaaaggucuagggaaaacauccauuggcuugcucugugugacggccucaagcgcacuguuauggauggccaguguggagccccauuggauagcggccuccaucauacuagaguucuuuuugauggugcugcucauuccagagccagacagacagcgcacuccacaggacaaccagcuagcauauguggugauagguuuguuauucaugauacugacaguggcagccaaugagaugggauuauuggaaaccacaaagaaagaccuggggauuggcuauguagccgccgaaaaccaccaacaugcuacaaugcuggacguagaccuacacccagcuucagccuggacccucuaugcaguagccacaacaguuaucacucccaugaugagacacacaauugaaaauacaacggcaaacauuucccugacagccauugcaaaucaggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugaugcaaaauuugaaaaacagcuaggccaaauaauguuacugauacuuuguacaucacagauccucuugaugcggaccacaugggccuugugugaauccaucacacuggcuacuggaccccugaccacucucugggagggaucuccaggaaaauucuggaauaccacaauagcaguguccauggcaaacaucuucaggggaaguuaucuagcaggagcaggucuggcuuucucauuaaugaaaucuuuaggaggagguaggagagguacgggagcucaaggggaaacacugggagagaaauggaaaagacaguuaaaccaacugagcaagucagaauucaacaccuacaaaaggagugggauuauggagguggacagauccgaagccaaagagggacugaaaagaggagaaacaaccaaacaugcagugucgagaggaacagccaaacugaggugguuuguggagaggaaccucgugaaaccagaagggaaagucauagaccucgguuguggaagagguggcuggucauauuauugugcugggcugaagaaaguuacugaagugaagggauacacaaaaggaggaccuggacaugaggaaccuaucccaauggcgaccuauggauggaaccuaguaaagcuacacucuggaaaggauguauuuuuuaugccaccugagaaaugugacacccuucugugugauauuggugaguccucuccgaauccaacuauagaagaaggaagaacguuacguguucuaaaaaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauucuacccaugaaauguauuggguuucauguggaacaggaaacauugugucggcagugaacaugacaucuagaauguuacugaaccgauucacaauggcucacaggaagccaacauaugaaagagacguggacuuaggcgcuggaacaagacauguggcaguggaaccagagguagccaaccuagauaucauuggccagaggauagagaauauaaaaaaugaacacaagucaacauggcauuaugaugaggacaauccauacaaaacaugggccuaucauggaucauaugaggucaagccaucaggaucagccucaucuauggugaauggaguggugagauugcucacaaaaccaugggauguuauccccauggucacacaaauagcuaugacugauaccacacccuuuggacaacagagaguguuuaaagagaaaguugacacgcgcacaccaagagcaaaacgaggcacaacacagauuauggaggugacagccaagugguuaugggguuuccuuuccagaaacaaaaaacccagaaucugcacaagagaggaguucacaagaaagguuaggucaaacgcagcaauaggagcaguguucguugaugaaaaccaauggaacucagcaaaagaagcaguggaagacgaaagguuuugggaucuugugcacagagagagggagcuucauaaacagggaaaaugugccacgugugucuacaacaugauggggaagagagagaaaaaauuaggagaguuuggaaaagcaaaaggaagucgugcaauaugguacauguggcugggagcacgcuuucuggaguucgaagcccuugguuucaugaaugaagaucacugguuuaguagagagaauucacucaguggaguggaaggagaaggacugcacaaacuuggauacauacuuagagacauaucaaagauuccggggggaaauauguaugcagaugauacagccggaugggacacaagaauaacagaggaugaucuucagaaugaggcuaaaaucacugacaucauggagccugaacaugcucuauuggcuacgucaauuuuuaagcugacuuaucaaaacaagguggugagggugcaaagaccagcaaaaaauggaaccgugauggaugucauauccagacgugaucagagaggaaguggacaggucggaacuuauggcuuaaauacuuucaccaauauggagguccaacuaauaagacaaauggagucugaaggaaucuuuuuacccagcgaauuggaaacccccaaccuagcugagagggcucuugacuggcuagaaaaacauggcgccgaaaggcugaaacgaauggcaaucagcggagaugauugcguggugaaaccaauugacgacagguucgcaacagccuuaacagcucugaaugacaugggaaaaguaagaaaagacauaccgcagugggaaccuucaaaaggauggaaugauuggcagcaagugccuuuuuguucacaccauuuccaccagcugaucaugaaggaugggagggaaauaguggugccaugccgcaaccaagaugaacuugugggcagggcuagaguaucacaaggcgccggauggagccugagagaaacugcuugccuaggcaagucauaugcacaaauguggcagcugauguacuuccacaggagagaccugagacuggcggcuaacgcuaucuguucagccgucccaguugauugggucccaaccagccgcacaaccuggucaauccaugcccaccaccaauggaugacaacagaagacauguuaucaguguggaauaggguuuggauagaggaaaacccauggauggaggacaaaacucauguauccaguugggaagaaguuccauaccuaggaaaaagggaagaccaaugguguggaucccugauaggcuugacagcgagggccaccugggccaccaacauacaaguagccauaaaccaagugagaaggcucaucgggaaugagaauuauuuagauuacaugacaucaaugaagagauucaagaaugagagugaucccgaaggagcacucugguaa

SEQ ID NO: 5645 - RNA, 9879 nt, Artificial Sequence
  derived and/or modified CDS sequence (wt) from DENV-1__GQ868601__SS-prME
uccgugaccaugcuccucaugcugcugcccacagcccuggcguuccauuugaccacacgagggggagagccacacaugauagucagcaagcaggaaagaggaaagucacucuuguuuaagaccucuguaggugucaauaugugcacucucauugcgauggauuugggagaguuaugugaggacacaaugaccuacaaaugcccccggaucacugaggcggaaccagaugacguugacugcuggugcaaugccacagacacaugggugaccuaugggacguguucucaaaccggcgaacaccgacgagacaaacguuccgucgcacuggccccacacgugggacuuggucuagaaacaagaacugaaacguggauguccucugaaggcgccuggaaacaaauacaaaaaguggagacuugggcuuugcgacacccaggauucacggugauagcccuuuucuuggcacaugccauaggaacauccaucacucagaaagggaucauuuucauuuugcugaugcugguaacaccaucaauggccaugcgaugcgugggaauaggcaacagagacuucguugaaggacugucaggagcaacguggguggacgugguacuggagcauggaagcugcgucaccaccauggcaaaaaacaaaccaacauuggacauugaacucuugaaaacggaggucacgaacccugccguccugcgcaaacugugcauugaagcuaaaauaucaaacaccaccaccgauucaagauguccaacacaaggagaagccacacugguggaagaacaagacgcgaacuuugugugucgacgaacguucguggacagaggcugggguaauggcugcggacuauuuggaaaaggaagucuacugacgugugcuaaguucaagugugugacaagacuagaaggaaagauaguucaauaugaaaacuuaaaauauucagugauagucacuguccacacuggggaccagcaccagguaggaaacgagacuacagaacauggaacaauugcaaccauaacaccucaagcuccuacgucggaaauacagcugaccgacuacggagcccucacauuggacugcucaccuagaacugggcuggacuuuaaugagauggugcuauugacaaugaaagaaaaaucauggcuuguccacaaacaaugguuucuagacuuaccacugccuuggacuucgggagcuucaacaucccaagagacuuggaacagacaagauuugcuggucacauucaagacagcucaugcaaagaagcaggaaguagucguacugggaucacaggaaggagcaaugcacacugcguugacuggggcgacagaaauccagacgucaggaacgacaacaaucuuugcgggacaccugaaauguagacuaaaaauggauaaacugacuuuaaaagggaugucauaugugaugugcacaggcucauuuaagcuagagaaggaaguggcugagacccagcauggaacuguuuuagugcagguuaaauacgaaggaacagaugcaccaugcaagauccccuuuuugacccaagaugagaaaggagugacccagaaugggagauugauaacagccaauccuauaguuacugacaaagaaaaaccagucaacauugagacagaaccaccuuuuggugagagcuacaucgugguaggggcaggugaaaaagcuuugaaacuaagcugguucaagaaaggaagcagcauagggaaaauguucgaagcaaccgcccgaggagcacgaagaauggccauccugggagacaccgcaugggacuucggcucuauaggaggauuguucacgucugugggaaaauugauacaccagguuuuuggaacugcauaugggguucuguucagcgguguuucuuggaccaugaaaauaggaauagggauucugcugacaugguugggauuaaauucaaggagcacgucacuuucaaugacgugcauugcaguuggcauggucacacuguaccuaggagucaugguucaagcggacucgggaugugugaucaacuggaagggcagagaacucaaauguggaaguggcauuuuugucacuaaugaaguccacacuuggacagagcaauauaaauuccaggcugacuccccaaaaagacugucagcagccauugggaaggcaugggaggaaggcguguguggaauucgaucagccacgcgucuugagaacaucauguggaagcaaauaucaaaugaauugaacuacauccuacuugaaaaugacaugaaauucacagugguuguaggagacgcuaauggaauuuuggcccaagggaaaaaaaugauuagaccacaacccauggaacacaaauacucauggaaaaguuggggaaaagccaaaaucauaggagcagacauacagaacaccaccuuuaucauugacggcccagauacuccagaaugccccgaugaccaaagagcauggaacauuugggaaguugaggacuauggguucggaauuuucacgacaaacauauggcugaaauugcgugacuccuacacccaaaugugugaccaccggcuaaugucagcugccaucaaggacagcaaggcaguccaugcugauaugggguacuggauagaaagugaaaagaacgagaccuggaagcuagcgagagccuccuuuauagaagucaagacaugcaucuggccgaaaucccacacucuauggaguaauggaguuuuggaaagugaaaugauaaucccaaagauauauggaggaccaauaucucagcacaacuacagaccaggguauuucacacaaacagcagggccauggcaccuaggcaaguuggaauuggauuuugacuugugugaagguaccacaguuguuguagaugaacauuguggauaucgagguccaucucucagaacuacaacaguuacaggaaagauaauccaugaaugguguugcagauccugcacguuaccccccuuacgcuucagaggagaagacggauguugguaugguauggaaaucagaccaguuaaggagaaggaggagaaccuaguuaggucaauggucucugcagggucaggagaaguggacaguuuuucauuaggaauacuaugcguaucaauacugauugaagaagugaugagauccagauggaguagaaggaugcugaugacuggaacacuggcuguuuuccuccuucuuauaaugggacaacugacauggaaugaucugaucagguuaugcaucaugguuggagccaaugcuucggacaggauggggauggggacaacguaccuagccuugauggccacuuucaaaaugagaccaauguucgcuguugggcuauuauuucgcagacuaacauccagagaaguucuucuucucacgauuggauuaagccugguggcauccguggagcuaccaaauucuuuagaggagcuaggggauggacuugcaaugggcaucaugauguuaaaauuauugacugacuuccagccacaccaguuauggaccacccuauugucucuaacauuuaucagaacaacucuuucauuggauuaugcauggaagacaauggcuauggcacugucaaucguaucucucuuuccuuugugucugucuacgaccucccaaaaaacaacauggcuuccggugcuguuaggaucuuuuggauguaaaccauuaaccauguuucucauaacagaaaacaaaaucuggggaaggaaaagcuggcccaucaaugaaggaauuauggcuguuggaauagucagcauucuacuaaguucacuccucaaaaaugaugugccgcuagccggcccacuaauagcuggaggcaugcuaauagcauguuaugucauauccggaagcucagcugauuuaucauuggagaaagcggcugagguauccugggaagaagaagcagaacacuccggcaccucacacaacauauuaguggagguccaagaugauggaacuaugaaaauaaaagaugaagagagggaugacacacucaccauacuccuuaaagcaacucugcuggcagucucaggaguguacccaaugucaauaccagcaacucuuuuugugugguauuuuuggcagaaaaagaaacagagaucaggaguguuaugggacacacccagcccuccggaaguggaaagggcaguucuugaugauggcauuuauagaaucuugcaaagaggacuguugggcaggucccaaguaggagugggaguuuuccaagacggcguguuccacacaauguggcacgucaccaggggagcuguccuuauguaccaagggaagaggcuggaaccaagcugggccagugucaaaaaagacuugaucucauacggaggagguuggagguuucaaggaucauggaacacgggagaagaagugcaggugauagcuguugaaccaggaaaaaaccccaaaaauguacagacaacgccggguaccuucaagacuccugaaggcgaaguuggagccauagcucuagauuuuaaacccggcacauccggaucucccaucgugaacagagagggaaaaauaguaggucuuuauggaaauggaguggugacaacaaguggaaccuacgucagugccaucgcucaagcuaaagcaucacaagaagggccucuaccagagauugaggacgagguguuuaagaaaagaaacuuaacaauaauggaccugcauccaggaucagggaaaacaagaagauaucuuccagccauaguccgugaggccauaaaaaggaagcugcgcacgcuaaucuuggcucccacaagaguugucgccucugaaauggcagaggcgcucaagggaaugccaauaagauaccagacaacagcagugaagagugaacauacaggaagggagauaguugaccucaugugccaugccacuuuuaccaugcgucucuuaucuccagugagaguucccaauuacaacaugauuaucauggaugaggcacauuuuacugauccagccagcauagcggccagaggguacaucucaacccgaguggguaugggugaagcagcugcgaucuucaugacagccacucccccaggaucgguggaggccuuuccacagagcaaugcaguuauccaagaugaggaaagagacauuccugagagaucauggaacucaggcuacgacuggaucacugauuuuccagguaaaacaguuugguuuguuccaagcaucaaaucaggaaaugacauugccaacuguuuaagaaagaacggaaaacgggugauucaacugagcaggaaaaccuuugacacugaguaccagaaaacaaaaaacaaugacugggacuacguugucacaacagacauuuccgaaaugggagcaaauuuccgggccgacaggguaauagauccaaggcggugcuugaaaccgguaauacuaaaggaugguccagagcgcgucauucuagccggaccgaugccagugacuguggccagugccgcccagaggagaggaagaauuggaaggaaccaaaacaaagaaggugaucaguacauuuacaugggacagccuuuaaauaaugaugaggaucacgcucauuggacagaagcaaaaaugcuccuugacaauauaaacacaccagaagggaucaucccagcccucuuugagccagagagagaaaaaagugcagcaauagacggggaguacagacugcggggagaagcaaggaaaacauucguggagcucaugagaagaggagaucuaccaguuuggcuauccuacaaaguugccucagaagguuuccaauacuccgacagaagauggugcuuugauggggaaaggaauaaccagguguuggaggagaacauggacguggagaucuggacaaaggaaggagaaagaaagaaauugcgaccccgcugguuggaugcuagaacauacucugauccacuggcccugcgcgaguuuaaagaguuugcagcaggaagaagaagugucucaggugaccuaauauuggaaauaggaaaacuuccacaacauuugacgcuaagagcccagaaugcucuggacaacuuggucauguugcacaauuccgaacaaggaggaaaagccuacagacaugcuauggaagaacuaccagacaccauagaaacauugaugcuccuagcuuugauagcugugcugacugguggagugacgcuguucuuccuaucaggaaaaggucuagggaaaacauccauuggccuacucugugugauggccucaagcgcacuguuauggauggccaguguggagccccauuggauagcggccuccaucauauuagaguucuuucugauggugcugcucauuccagagccagacagacagcgcacuccacaggacaaccaguuagcauauguggugauagguuuguuauucaugauacugacaguggcagcuaaugagaugggauugcuggaaaccacaaagaaagaccuggggauuggccauguagccgccgaaaaccaccaccaugccacaaugcuggacguagaccuacguccagcuucagccuggacccucuaugcaguagccacaacaguuaucacccccaugaugagacacacaauugaaaauacaacggcaaauauuucccugacagccauugcaaaccaggcagcuauauugauggggcuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguuacaauagacuuggauccugugguuuaugaugcaaaauuugaaaaacagcuaggucaaauaauguuacugauacuuuguacaucacagauucucuugaugcggaccacaugggccuugugugaauccaucacacuggcuacuggacccuugaccacucuuugggagggaucuccaggaaaauucuggaauaccacgauagcaguguccauggcaaacaucuucaggggaaguuaucuagcaggagcaggucuggccuucucauugaugaaaucuuuaggaggagguaggagagguacgggagcucaaggggaaacacugggagaaaaauggaaaagacagcuaaaccaacugagcaagucagaauuuaacaccuacaaaaggagugggauuauggagguggacagauccgaagccaaagagggauugaaaagaggagaaacaaccaaacaugcagugucgagaggaacagccaaacugaggugguuuguggagaggaaccucgugaaaccagaagggaaagucauagaccucgguugugggagagguggcuggucauauuacugcgcugggcugaagaaagucacugaagugaagggauacacaaaaggaggaccuggacaugaggaacccaucccaauggcgaccuauggauggaaccugguaaagcuacacucugggaaagauguauucuucacaccaccugagaaaugugacacccuuuugugugacauuggugaguccucuccaaauccaacuauagaagaaggaagaacauuacguguucuaaagaugguggaaccauggcucagaggaaaccaauucugcauaaaaauccuaaauccuuacaugccaagugugguagaaacucuggagcaaaugcaaagaaaacauggagggaugcuagugcgaaacccacucucaagaaauuccacccaugaaauguacuggguuucauguggaacaggaaacauugugucggcagugaacaugacauccagaauguuacugaaccgauucacaauggcucacaggaagccaacauaugaaagagacguggacuuaggcgcuggaacaagacauguggcaguggaaccagagguagccaaccuagauaucauuggccagaggauagagaacauaaaaaaugaacacaagucaacauggcauuaugaugaagacaauccauacaaaacaugggccuaucauggaucauaugaggucaagccaucaggaucagccucauccauggugaauggcguggugagauugcucaccaaaccaugggauguuauccccauggucacacaaauagcuaugacugauaccacacccuucggacaacagaggguguuuaaagagaaaguugacacgcgcacaccaagagcaaaaagaggcacagcacaaauuauggaggugacagccaagugguuaugggguuuccuauccagaaacaaaaaacccagaaucugcacaagagaggaguucacaagaaaaguuaggucaaacgcagcaauaggagcaguguucguugaugaaaaccaauggaacucagcaaaagaagcaguggaagacgaaagguuuugggaucucgugcacagagagagggagcuucauaaacagggaaaaugugccacguguguuuacaauaugauggggaagagagaaaaaaaauuaggagaguucggaaaagcaaaaggaagucgugcaauaugguacauguggcugggagcacgcuuucuagaguuugaagcccuugguuucaugaaugaagaucacugguucaguagagagaauucacucaguggaguggaaggagaaggacugcacaaacuuggauacauacucagagacauaucaaagauuccggggggaaauauguaugcagaugacacagccggaugggacacaagaauaacagaggaugaucuucagaaugaggcuaaaaucacugacaucauggagccugaacaugcucuauuggcuacgucaauuuuuaaacugaccuaccaaaauaagguggugagggugcaaagaccagcaaaaaguggaaccgugauggaugucauauccagacgugaccagagaggaaguggacaggucggaacuuauggcuuaaauacuuucaccaauauggagguccaauuaauaagacaaauggagucugaaggaauuuuuucacccagcgaauuggaaacccccaaucuagcuaagagaguucuugacugguuggaaaaacaaggcgccgaaaggcugaaaagaauggcaauuagcggagaugauuguguggugaaaccaauugaugacagguucgcaacagccuuaacagcuuugaaugauaugggaaaaguaagaaaagacauaccgcagugggaaccuucaaaaggauggaaugacuggcagcaagucccuuucuguucacaccacuuccaccagcugaucaugaaagauggaagagaaauaguggugccaugccgcaaccaagaugaacuugugggcagggcuagaguaucacaaggcgccggauggagccugagagaaacugcuugccuaggcaagucauaugcacaaauguggcagcugauguacuuucacaggagagaccugagacuagcggcuaaugcuaucuguucagccgucccaguugauugggucccaaccagccgcacuaccuggucgauccaugcccaccaccaauggaugacaacagaagacauguuaucaguguggaauaggguuuggauagaggaaaacccauggauggaagacaaaacucauguauccaguugggaagaaguuccauaccuagggaaaagggaagaucaaugguguggaucccugauagguuugacagcgagggccaccugggccacuaacauacaaguagccauaaaccaagugagaaggcucaucgggaaugagaauuaucuagauuauaugacaucaaugaagagauucaagaaugagagugaucccgaaggggcacucugguaa

SEQ ID NO: 5646 - RNA, 9879 nt, Artificial Sequence
  derived and/or modified CDS sequence (wt) from DENV-1__EU660390__SS-prME
ucugugacuaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggugagcaccgacgagacaaacguuccgucgcacuggccccacacgugggacuugguuuggaaacaagaaccgaaacguggauguccuccgaaggcgcuuggaaacagauacaaagaguggagacuugggcccugagacauccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauauucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugagaaagcuuugaaacuaaguugguucaagaaaggaagcagcauagggaaaauguuugaggcaacugccagaggagcacgaaggauggccauacugggagacaccgcaugggacuuugguuccauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucucuuucgaugacgugcauugcaguuggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugauuguaggagauguugcugggaucuugggccaaggaagaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucaacacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcuaggggauggacuugcaaugggcauuaugauuuuaaaauuguugacugacuuucaaucacaucagcugugggcuaccuugcuguccuugacauuuaucaaaacaacauuuuccuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaguagcuggaggcaugcuaauagcauguuauguuauaucuggaagcucagccgaucuaucacuagagaaagcggcugaggucuccugggaagaagaagcagagcacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguuggguaggucccaaguagggguaggaguuuuucaagaaaacguguuccacacaauguggcaugucaccaggggagcuguacucauguaucaagggaagagacuagaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaacggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauagucgaccucaugugucacgccacuuucaccaugcgccuccugucucccgugagaguucccaauuacaacaugauuaucauggaugaagcacauuuuacagauccauccagcauagcggccagaggguacaucucaacucgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaaugaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugauuuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauaggaguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccgauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacguaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgaaaccaagaugaacuuguggguagggcuagaguaucacaaggugcuggauggagccugagagaaacugcaugccuaggcaaaucauaugcacaaauguggcagcugauguacuuccacaggagagaccugagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagacuacaugacaucaaugaagagauucaagaacgagagugaucccgaaggggcacucugguga

SEQ ID NO: 5647 - RNA, 9879 nt, Artificial Sequence
  derived and/or modified CDS sequence (wt) from DENV-1__EU660391__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggucuaguaacauuguaccuaggaguuaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccacuuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaugggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuucugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaagacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagauuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccuaacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaauaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcccugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguugggaagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5648 - RNA, 9879 nt, Artificial Sequence
  derived and/or modified CDS sequence (wt) from DENV-1__EU660393__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgccuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugccgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauucaaacguccggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaauaacccagagugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaagcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugagggcaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcggcuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcagucauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacucugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauagaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguugaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccaggcgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5649 - RNA, 9879 nt, Artificial Sequence
  derived and/or modified CDS sequence (wt) from DENV-1__EU660401__SS-prME
ucugugaccaugcuccuuaugcuaaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaauaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5650 - RNA, 9879 nt, Artificial Sequence
  derived and/or modified CDS sequence (wt) from DENV-1__FJ373305__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugauaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaauaaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacgguuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggccguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguucaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagcuauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaagucaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5651 - RNA, 9879 nt, Artificial Sequence
  derived and/or modified CDS sequence (wt) from DENV-1__EU660402__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaauagaugcaccaugcaagaucccuuuuucgacccaagaugaaaaaggaguaacccagaaugggagacuaauaacagccaacccuauagucacugacaaagaaaaaccagucaauauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaagggaaaaaaaugauuaggccacaacccauggaauacaaauacucguggaaaaucuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuagaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuacgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugacggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuucaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugaucaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugaccguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuaucccacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugaugcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagguccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaauuauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugcuacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauacauacucagagacauaucaaagauuccagggggaaacauguaugcagaugacacagccggaugggacacaaggauaacagaggaugaccuucagaacgaggccaaaauuacugacaucauggaacccgaacaugcccuacuggcuaagucaaucuucaaguuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaacgauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5652 - RNA, 9879 nt, Artificial Sequence
  derived and/or modified CDS sequence (wt) from DENV-1__EU660403__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagauacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaauaaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauacuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaauuauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaagaauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5653 - RNA, 9879 nt, Artificial Sequence
  derived and/or modified CDS sequence (wt) from DENV-1__EU660397__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagagcacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaacaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5654 - RNA, 9879 nt, Artificial Sequence
  derived and/or modified CDS sequence (wt) from DENV-1__EU687247__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcagaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggcuauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaaucuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccgucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuucaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaggagauaguugaccucaugugucacgccacuuucacuaugcgccuccugucucccgugagaguucccaauuacaacaugaucaucauggaugaagcacauuucaccgauccauccagcauagcggccagaggguacaucucaacccgagugggcaugggugaggcagcugcgaucuucaugacagcuacucccccaggaucaguggaggccuuuccacagagcaacgcaguuauccaagaugaggaaagagacauucccgagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagguccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaaguuacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauaucggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaguuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucaacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5655 - RNA, 9879 nt, Artificial Sequence
  derived and/or modified CDS sequence (wt) from DENV-1__EU660412__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaauggugcuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccaguuaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauugugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacguuagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagaucugaagccaaagagggauugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaagcucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugauaucaaugaagagauucaagaacgagagugaucccgaaggggcacucugguga

SEQ ID NO: 5656 - RNA, 9879 nt, Artificial Sequence
  derived and/or modified CDS sequence (wt) from DENV-1__EU660418__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcaucuuugucaccaaugaaguccacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggauuuuggcucaaggaaagaaaaugaucaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaagaugaagagagagaugacacgcuaaccauucuccuuaaagcaacucuguuagcaguuucagggguguacccauuaucaauaccagcgacccucuucguguggcacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuauucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuauuacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccagcuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5657 - RNA, 9879 nt, Artificial Sequence
  derived and/or modified CDS sequence (wt) from DENV-1__EU677151__SS-prME
ucugugaccaugcuccuuaugcugauaccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaagcugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagucugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugagaugguguuguugacaaugaaagaaaaaucauggcuaguccacaaacaaugguuucuagaccuaccauugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguuuuagugcagauuaaauacgaaggaacagaugcaccaugcaagauccccuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggagcaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaaugguugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugagguuucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaggggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguaauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauauuagagauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucuaaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagaggugguuggucauauuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgcaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacaucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugucuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5658 - RNA, 9879 nt, Artificial Sequence
  derived and/or modified CDS sequence (wt) from DENV-1__EU677152__SS-prME
ucugugaccaugcuccuuauguugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacuguguauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaagggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaacuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaacuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacauuauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaaaacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccucuugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccgggcaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaccaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaauuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccaugcggcuguugaaaaucaccaccaugccgcaaugcuggacguagacuuacauccagcuucagccuggacccucuaugcaguggccacaacaaucaucacucccaugaugaggcacacaaucgaaaacacaacggcaaacauuucccugacagccauugcaaaccaggcggccauauugaugggacuugacaaaggauggccaauaucaaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguagagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugauacccuucugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagauaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5659 - RNA, 9879 nt, Artificial Sequence
  derived and/or modified CDS sequence (wt) from DENV-1__EU677155__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgauucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucgcuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcaccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcugggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5660 - RNA, 9879 nt, Artificial Sequence
  derived and/or modified CDS sequence (wt) from DENV-1__EU677157__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacgcuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuauggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacugagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacaggccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggagcagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucacucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcaucuuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgacccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccugaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaagaugaccuucagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccaagagaguucucgacuggcuggaaaaauauggcgucgaaaggcugaaaagaauggcaaucagcggagaugacugcguagugaaaccaauugaugauagguuugcaacagccuugacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5661 - RNA, 9879 nt, Artificial Sequence
  derived and/or modified CDS sequence (wt) from DENV-1__EU677158__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagauacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaauaaucgaggaggugaugagauccagauggaguagaaaaaugcugaugacuggaacacuggcuguguucguccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauacuggcccccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuaugucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaauuauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaagacugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaucaagugagaagacuaauugggaaugagaauuaucuagauuacaugacaucaaugaagagauucaagaacgagggugaucccgaaggggcacucugguga

SEQ ID NO: 5662 - RNA, 9879 nt, Artificial Sequence
  derived and/or modified CDS sequence (wt) from DENV-1__EU677159__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguucguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaauggugcuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccaguuaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauugugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccaauaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacguuagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucucugaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagaucugaagccaaagagggauugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaagcucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcugggaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugauaucaaugaagagauucaagaacgagagugaucccgaaggggcacucugguga

SEQ ID NO: 5663 - RNA, 9879 nt, Artificial Sequence
  derived and/or modified CDS sequence (wt) from DENV-1__EU677160__SS-prME
ucugugaccaugcuccuuaugcugaugccuacagccuuggcguuccauuugacuacacgagggggagagccgcacaugauaguuagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuagugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucauuggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuguuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagaccauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguagagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggaggguggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuugacaauaauggaccuacauccaggaucggggaaaacaagaagauaucuuccagccauaguccgugaggccauaaaaaggaagcugcgcacauuaauucuggcucccacaagaguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuuuaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguauaucuacaugggacagccuuuaaacaacgaugaagaucaugcucacuggacagaagcaaaaaugcuccuugauaauauaaacacaccagaagggauuaucccagcccucuucgagccggagagagagaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacguacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuagggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacucugggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacauuauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccaggagaguucuugacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccaguugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaucaagugagaagacuaauugggaaugagaauuaucuagauuacaugacaucaaugaagagauucaagaacgagagugauccugaaggugcacucugguga

SEQ ID NO: 5664 - RNA, 9879 nt, Artificial Sequence
  derived and/or modified CDS sequence (wt) from DENV-1__EU677162__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauagguagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcugggguaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacagugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaauuaagcugguucaagaaaggaagcagcauagggagaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcugccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuagcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuauccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcugggggcaugcuaauagcauguuauguuauaucuggaagcucagccgaccuaucacuagagaaagcagcugaggucuccugggaagaagaagcagaacacucuggugccucacacaacauauuaguggaaguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugccuuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaacuguugauggaauuguugcaauagacuuggauccugugguuuaugaugcaaaauuugagaagcaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaaccauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacaacaccuuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccgugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauuuaagaacgagagugacccugaaggggcacucugguga

SEQ ID NO: 5665 - RNA, 9879 nt, Artificial Sequence
  derived and/or modified CDS sequence (wt) from DENV-1__EU677164__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacguaggacuugguuuggaaacaagaacagaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauagccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaucaccggcuaaugucagcugccaucaaggacagcaaggcaguucacgcugacaugggguacuggauagaaagugaaaagaacgagaccuggaagcuggcaagagccuccuucauagaaguuaaaacauguaucuggccaaagucccacacucuauggagcaauggaguucuggaaagugaaaugauaauuccaaagaacuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcugugcucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacaacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaacuaugaagauaaaggaugaagagagagaugacacgcuaaccacucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaaccuaacaauaauggaccuacauccaggaucggggaaaacaagaagauaucuuccagccauaguccgugaggccauaaaaaggaagcugcguacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacuccuccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaagcuuccacaacacuugacgcaaagggcccagaacgccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacguugacagcggcgguguugaugcuaguggcucauuacgccauaauuggaccuggacugcaagcaaaagcuacuagagaagcucaaaaaaggacagcggccggaauaaugaagaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaccuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaggccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucaucuauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguuuacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaagagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaaguuagaagacuaauugggaaugagaauuaucuagauuacaugacaucaaugaagagauucaagaacgagagugauccugaaggggcacucugguga

SEQ ID NO: 5666 - RNA, 9879 nt, Artificial Sequence
  derived and/or modified CDS sequence (wt) from DENV-1__EU677165__SS-prME
ucugugaccaugcuccuuaugcugaugccuacagccuuggcguuccaucugacuacacgagggggagagccgcacaugauagucagcaagcaggaaagaggaaagucacucuuguuuaagaccucagcagguguuaacaugugcacccuuauagcgauggauuugggagaguuaugugaggacacaauaacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcuggcaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccccaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucugguacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacggcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgagucuaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcugugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguagaaacucuggagcaaaugcaaagaaaacaugggggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuugcuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5667 - RNA, 9879 nt, Artificial Sequence
  derived and/or modified CDS sequence (wt) from DENV-1__EU677140__SS-prME
ucugugaccaugcuccuuaugcugaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacguuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaauguccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaggaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugauggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacuaugcguaauggcuucaagcguuuugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggauagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcugaaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5668 - RNA, 9879 nt, Artificial Sequence
  derived and/or modified CDS sequence (wt) from DENV-1__EU677166__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguagccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaauacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguucgcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggagguccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauccugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaaucuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguuaauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5669 - RNA, 9879 nt, Artificial Sequence
  derived and/or modified CDS sequence (wt) from DENV-1__EU677170__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuugcuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacugucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggaugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagaaagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaauaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaagaggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugucucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaauuuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaagugagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5670 - RNA, 9879 nt, Artificial Sequence
  derived and/or modified CDS sequence (wt) from DENV-1__EU677171__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaucaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuucuugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5671 - RNA, 9879 nt, Artificial Sequence
  derived and/or modified CDS sequence (wt) from DENV-1__EU677172__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaaguuacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugaucaggccacaacccauggaauacaaauacucguggaaaagcuggggaaaggcuaaaaucauaggggcagaugcacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucacaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucacuaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5672 - RNA, 9879 nt, Artificial Sequence
  derived and/or modified CDS sequence (wt) from DENV-1__EU677173__SS-prME
ucugugaccaugcuucuuaugcugaugcccacagccuuggcguuccaucugacuacacgagggggagagccgcauaugauaguuaccaagcaggaaagaggaaagucacucuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggugcuuggaaacagauacaaagaguggagacuugggcccugagacacccaggauucacggugauagcccuuuuuuuagcacaugccauaggaacauccaucacccagaaggggauuauuuucauuuuguuaaugcugguaacaccauccauggccaugcgaugcgugggaauaggcagcagggacuucguggaaggacugucaggagcaaccuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaaugguugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacacgggacaacugcaacuauaacaccucaagcucccacgucggaaauacaacugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggacuucaggagcuacaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauauguaaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccaccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaaaugugugaccaccggcuaaugucagcugccaucaaggacagcaaggcaguucaugcugacaugggguacuggauagaaagugaaaagaacgagaccuggaagcuggcaagagccucuuucauagaaguuaaaacauguauuuggccaaaaucccacacucuauggagcaacggaguucuggaaagugaaaugauaauuccaaagaucuauggaggaccaauaucucagcacaacuacagaccaggauauuucacacaaacggcagggccauggcaccuagguaaguuggaacuggauuuugauuugugugaggguaccacaguuguuguggaugaacauuguggaaaccgaggaccaucucuuagaaccacaacagucacaggaaagauaauucaugaaugguguugcagaucuuguacgcuaccacccuuacguuucaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcuguugggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaaaacaauggcuaugguacugucaauuguaucucucuuccccuuaugccuguccacgaccucccaaaaaacaacguggcuuccggugcuauugggaucucuuggaugcaagccacuaaccauguuucucauaacagaaaacaaaaucuggggaaggaaaaguuggccccucaaugaaggaaucauggcuguuggaguagucaguauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccucaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaauguguuccacacaauguggcaugucaccaggggagcuguacucauguaccaagggaagagacuggaaccgaguugggccagugucaaaaaagaccugaucucauauggaggagguuggaggcuucaaggauccuggaacgcgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcuacgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgaguggguaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagcugacagagugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccucuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguugagaucuggacaaaggaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuugcauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacccugacagcggcgguauugaugcuaguggcucauuacgccauaauuggaccuggacuacaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaaaucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaauauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacauaagucaacauggcacuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguuugaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaacuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacucguggguagggcuagaguaucacaaggugcuggauggagccugagagaaacugcaugccuaggcaagucauaugcacaaauguggcagcugauguacuuucacaggagagaccugagacuagccgccaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagacuacaugacaucaaugaagagauucaagaacgagggugaucccgaaggggcacucugguga

SEQ ID NO: 5673 - RNA, 9879 nt, Artificial Sequence
  derived and/or modified CDS sequence (wt) from DENV-1__EU726779__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaaaaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacguccuuuucgaugacgugcauugcaguuggccuaguaacacuauaccuaggagucaugguucaggcggauucaggauguguaauaaauuggaaagguagagaacucaaauguggaaguggcaucuuugucaccaaugaaguccacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugaucaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacgaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggacuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaagaugaagagagagaugacacgcuaaccauucuccuuaaagcaacucuguuagcaguuucagggguguacccauuaucaauaccagcgacccucuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuauuacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccagcuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5674 - RNA, 9879 nt, Artificial Sequence
  derived and/or modified CDS sequence (wt) from DENV-1__EU677176__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagucugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguuuauucaagcuagagaaagaaguggcugagacccagcauggaaccguuuuagugcagauuaaauacgaaggaacagaugcaccaugcaagauccccuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauccgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccggaaguagaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaaaaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuauaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaacuuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucauccuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugacaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcucugcgcgaguuuaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccuugguuguggaagagguggcuggucauacuauugcgcugggcugaagaaagucacagaagugaagggauacacaaaaggaggacccggacaugaagaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuaauaagacaaauggagucugagagaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugucuaggcaagucauaugcacaaauguggcaacugauguacuuccacaggagagaccugagauuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgauagugaucccgaaggggcacucugguga

SEQ ID NO: 5675 - RNA, 9879 nt, Artificial Sequence
  derived and/or modified CDS sequence (wt) from DENV-1__EU726780__SS-prME
ucugugaccaugcuccuuaugcugaugccuacagccuuggcguuccauuugacuacacgaggaggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuuuggaaaagggagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauaaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaaacuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccucucgaugacgugcauugcaguuggccuaguaacacuauaccuaggagucaugguucaggcggauucaggauguguaauaaauuggaaagguagagaacucaaauguggaaguggcauuuucgucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaucggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggucaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaagcgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauaucagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccauuauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggcuggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccauaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcaucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucaauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5676 - RNA, 9879 nt, Artificial Sequence
  derived and/or modified CDS sequence (wt) from DENV-1__EU726781__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaacagaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaagggguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauuguaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaucaccggcuaaugucagcugccaucaaggacagcaaggcaguucacgcugacaugggguacuggauagaaagugaaaagaacgagaccuggaagcuggcaagagccuccuucauagaaguuaaaacauguaucuggccaaagucccacacucuauggagcaauggaguucuggaaagugaaaugauaauuccaaagaacuauggaggaccaauaucucaacacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacgauucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcugugcucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacaacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaaccuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccuuaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacuccuccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaagcuuccacaacacuugacgcaaagggcccagaacgccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacguugacagcggcgguguugaugcuaguggcucauuacgccauaauuggaccuggacugcaagcaaaagcuacuagagaagcucaaaaaaggacagcggccggaauaaugaagaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaccuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucaucuauggucaauggcguggugaaacugcucaccaagccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguuuacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaagagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaaguuagaagacuaauugggaaugagaauuaucuagauuacaugacaucaaugaagagauucaagaacgagagugauccugaaggggcacucugguga

SEQ ID NO: 5677 - RNA, 9879 nt, Artificial Sequence
  derived and/or modified CDS sequence (wt) from DENV-1__EU726782__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagauacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaauaaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauacuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuaugucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugacuacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaauuauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaucccaaauuuagccgagagaguucucgacuggcuggaaaaauauggcgucgaaagacugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5678 - RNA, 9879 nt, Artificial Sequence
  derived and/or modified CDS sequence (wt) from DENV-1__EU677178__SS-prME
ucugugaccaugcuccuuaugcugaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacacuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuuguuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugacguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagacuugaucucauauggaggagguuggaggcuucaaggauccuggaacacaggagaagaagugcaggugauugcuguugaaccagggaaaaaccccaaaaacguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccucuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagauagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacaacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuuuaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5679 - RNA, 9879 nt, Artificial Sequence
  derived and/or modified CDS sequence (wt) from DENV-1__EU687251__SS-prME
ucugugaccaugcuccuuaugcugaugccuacagccuuggcguuccauuugacuacacgagggggggagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcuaguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauuuaaacuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaaucguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccugguacaucuggaucucccaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccuuaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaauggcaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuauuccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacauuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacuaagcaagucagaauuuaacaccuauaaaaggagugggaucauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacaugggggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagaucccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcugaaaaaauauggcgucgaaaggcugaaaagaauggcaaucagcggagaugacugcguagugaaaccaauugaugauagguuugcaacagccuugacagcucugaaugauaugggaaaagugagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5680 - RNA, 9879 nt, Artificial Sequence
  derived and/or modified CDS sequence (wt) from DENV-1__FJ024427__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccggcuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggagcagaugcaccaugcaagaucccuuuuucgacccaagaugaaaaaggaauaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguaggaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacacccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuauuccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccugucaggaaggggccuagggaaaacaucuauuggccuacucugcguaauggcuucaagcguacugcuauggauggccaguguggagccccauuggauagcggccuccaucauacuggaguucuucuugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucaacagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugacagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauaucuagggaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5681 - RNA, 9879 nt, Artificial Sequence
  derived and/or modified CDS sequence (wt) from DENV-1__FJ024428__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugacagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauagugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuacuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaguuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaagaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaagucgccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccaccggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaucagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaguauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagcggcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5682 - RNA, 9879 nt, Artificial Sequence
  derived and/or modified CDS sequence (wt) from DENV-1__FJ024429__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugaugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaauagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauagugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaguuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcaaaaaaagaaacagagaucugggguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaagaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaagaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauuaaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaguauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5683 - RNA, 9879 nt, Artificial Sequence
  derived and/or modified CDS sequence (wt) from DENV-1__FJ024430__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucucaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccaugcuucuuauagcagaaaacaaaaucuggggaaggagaaguuggccccucaaugaaggaaucauggcuguuggaauagucagcauccuauuaaguucacuccucaaaaaugauguaccgcuagcugggccacuaauagcuggaggcaugcuaauagcauguuauguuauaucuggaagcucagccgcccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcagaaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaauacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaagcuaaccuaccaaaauaaggugguaaggguacagagaccaacaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaguugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5684 - RNA, 9879 nt, Artificial Sequence
  derived and/or modified CDS sequence (wt) from DENV-1__FJ024433__SS-prME
ucugugaccaugcuccuuaugcugaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacgccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaauaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucugguacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacggcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugcugcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguagaaacucuggagcaaaugcaaagaaaacaugggggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggaaccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguugggaagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5685 - RNA, 9879 nt, Artificial Sequence
  derived and/or modified CDS sequence (wt) from DENV-1__FJ024434__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaauggugcuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccaguuaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauugugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcugucuuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacguuagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguauaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuccucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccgcuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagaucugaagccaaagagggauugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaagcucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcgaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugauaucaaugaagagauucaagaacgagagugaucccgaaggggcacucugguga

SEQ ID NO: 5686 - RNA, 9879 nt, Artificial Sequence
  derived and/or modified CDS sequence (wt) from DENV-1__FJ024435__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugacagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauuuaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauagugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuacuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaguuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaagaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaagucgccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaguauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagacguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5687 - RNA, 9879 nt, Artificial Sequence
  derived and/or modified CDS sequence (wt) from DENV-1__FJ024436__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagagcuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuaucuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucagugauagucaccguccacacuggagaccagcaccaggugggaaaugaaagcacagaauacgggacaacugcaacuauaacaccucaagcuccuucaacggaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagagacuuggaacagacaagauuugcuugugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacaugcauugcaguuggccuaguaacauuauaccuaggagucaugguucaggcggauucaggauguguaauuaauuggaaaggcagagaacucaaauguggaaguggcauuuuugucaccaaugaaguucacacuuggacagagcaauacaaauuucaagcugacuccccaaagagacuaucagcugccaucgggaaggcaugggaugaggguguguguggaauacgaucagcaacucgucucgagaacaucauguggaagcaaauaucaaaugaacugaaccacaucuuacuugaaaaugacaugaaauucacaguggucguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuagcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuuaauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuagcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguauuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucucauagcagaaaacaaaaucuggggaaggaaaaguuggccccucaaugagggaaucauggcuguuggaauagucagcauucuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuccaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccccuaccagagauugaaaacgaaguguuuaggaaaagaaacuuaacaauaauggaccuacauccaggaucggggaaaacaagaagauaucuuccagccauaguccgugaggccauaaaaaggaaguugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucacugauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaguugagcagaaaaacuuuugauacagaguaccaaaaaacaaaaaauaacgacugggacuacgucgucacaacagacaucucugaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccaggugcuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaaaaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcgaaccaggcggcuauauuaaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccagcugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaauauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauaggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucucucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucgaucuuuaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacagguggccauaaaccaagugagaagacuaauugggaaugagaauuaucuagauuacaugacaucaaugaagagauucaagaacgagagugauccugaaggggcacucugguga

SEQ ID NO: 5688 - RNA, 9879 nt, Artificial Sequence
  derived and/or modified CDS sequence (wt) from DENV-1__FJ024472__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggaucauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccgucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacaggccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcugugaucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguucgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacauuucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaacauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaaaggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucauaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuacggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5689 - RNA, 9879 nt, Artificial Sequence
  derived and/or modified CDS sequence (wt) from DENV-1__FJ024439__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaaaaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacguccuuuucgaugacgugcauugcaguuggccuaguaacacuauaccuaggagucaugguucaggcggauucaggauguguaauaaauuggaaagguagagaacucaaauguggaaguggcaucuuugucaccaaugaaguccacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugaucaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacgaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggacuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaagaugaagagagagaugacacgcuaaccauucuccuuaaagcaacucuguuagcaguuucagggguguacccauuaucaauaccagcgacccucuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuacagacaagcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuauuacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccagcuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5690 - RNA, 9879 nt, Artificial Sequence
  derived and/or modified CDS sequence (wt) from DENV-1__FJ024441__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuauaaaugcccucgaaucacugaaacugaaccagaugacguugauuguugguguaaugccacagacacaugggugaccuauggaacauguucccaaacuggcgagcaccggcgagacaaacguuccgucgcacuggccccacacgugggacuugguuuggaaacaagaaccgaaacguggauguccucugaaggcgcuuggagacagauacaaagaguggagacuugggcccugagacacccaggguucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacagaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucacaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaauuauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacaugugucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacuacuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauucuuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccaggaaaaaaccccaaaaauguacaaacagcgccgggcaccuuuaagaccccugaaggugaaguuggagccauugcccuagacuuuaaaccuggcacaucuggaucucccaucgugaacagagaaggaaagauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggacuuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagauauggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaauuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaauaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauaugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuugaacacuuucaccaacauggaagcccagcugauaagacaaauggagucugagggaaucuucucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5691 - RNA, 9879 nt, Artificial Sequence
  derived and/or modified CDS sequence (wt) from DENV-1__FJ024442__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucucaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguucugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauugcucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaacgaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuuaauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaagaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaaaggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacuuaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccuaacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaucuaguaaagcugcacucugggaaagacguauucuuuauaccaccugagaaaugugacacccuuuugugugauauuggugaguccucuccaaacccaacuauagaggaagggagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccaacugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5692 - RNA, 9879 nt, Artificial Sequence
  derived and/or modified CDS sequence (wt) from DENV-1__FJ373296__SS-prME
ucugugaccaugcuccuuaugcugaugccuauagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauccccuuuucgacccaagaugagaaaggagcaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcguacacuaauucuggcucccacaaggguugucgcuucugaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugccuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauauagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccaaguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcccaaggggaaacacugggagaaaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacaccacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcaacugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaccaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugauccugaaggggcacucugguga

SEQ ID NO: 5693 - RNA, 9879 nt, Artificial Sequence
  derived and/or modified CDS sequence (wt) from DENV-1__FJ182018__SS-prME
ucugugaccaugcuccuuaugcugaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaggaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaaguacaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaauuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacucuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugagguuaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuauuuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5694 - RNA, 9879 nt, Artificial Sequence
  derived and/or modified CDS sequence (wt) from DENV-1__FJ410287__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagauacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaucucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaauaaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugcaucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauacuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaauuauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5695 - RNA, 9879 nt, Artificial Sequence
  derived and/or modified CDS sequence (wt) from DENV-1__FJ432719__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacggcggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugauggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaauuccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuuuuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5696 - RNA, 9879 nt, Artificial Sequence
  derived and/or modified CDS sequence (wt) from DENV-1__FJ182020__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugugucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuagcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaacuauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcucaugagaagaggagaucuaccugucuggcuauccuacaaaguugccucagaaggcuuucaguacucugacagaagauggugcuuugacggggaaaggaauaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcuaacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaaccauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacaacaccuuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5697 - RNA, 9879 nt, Artificial Sequence
  derived and/or modified CDS sequence (wt) from DENV-1__FJ182022__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucugguacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacggcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguagaaacucuggagcaaaugcaaagaaaacaugggggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5698 - RNA, 9879 nt, Artificial Sequence
  derived and/or modified CDS sequence (wt) from DENV-1__FJ024447__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaaguaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugaucaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccucuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuauuacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccagcuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5699 - RNA, 9879 nt, Artificial Sequence
  derived and/or modified CDS sequence (wt) from DENV-1__FJ182025__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucucaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuauuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccucucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcuuaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauagcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuccagaaugaggccagaauuacugacaucauggaaccugaacaugcccuacuggcuaagucaaucuucaagcuaaccuaccaaaauaaggugguaaggguacagagaccaacaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaguugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5700 - RNA, 9879 nt, Artificial Sequence
  derived and/or modified CDS sequence (wt) from DENV-1__FJ373297__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagggccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagucugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguuuauucaagcuagagaaagaaguggcugagacccagcauggaaccguuuuagugcagauuaaauacgaaggaacagaugcaccaugcaagauccccuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauccgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguagaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucaugccacuuucaccaugcgucuccugucuccugugagaguucccaauuauaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaacuuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcgugucauccuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugacaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccuugguuguggaagagguggcuggucauacuauugcgcugggcugaagaaagucacagaagugaagggauacacaaaaggaggacccggacaugaagaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugucuaggcaagucauaugcacaaauguggcaacugauguacuuccacaggagagaccugagauuagccgcuaaugcuaucuguucagccguuccaguugauugggucccaaccaaccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgauagugaucccgaaggggcacucugguga

SEQ ID NO: 5701 - RNA, 9879 nt, Artificial Sequence
  derived and/or modified CDS sequence (wt) from DENV-1__FJ024448__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaauaacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucugguacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacggcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcagcuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguagaaacucuggagcaaaugcaaagaaaacaugggggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5702 - RNA, 9879 nt, Artificial Sequence
  derived and/or modified CDS sequence (wt) from DENV-1__FJ182026__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccucauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaaaaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacgcaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuggggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagcuucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5703 - RNA, 9879 nt, Artificial Sequence
  derived and/or modified CDS sequence (wt) from DENV-1__FJ182027__SS-prME
ucugugaccaugcuccuuaugcugaugccuacagccuuggcguuccaucugacuacacgagggggagagccgcacaugauagucagcaagcaggaaagaggaaagucacucuuguuuaagaccucagcaggugucaacaugugcacccuuauagcgauggauuugggagaguuaugugaggacacaauaacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccccaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucugguacgacaacaauuuuugcaggacacuugaaaugcagacuaaagauggacaaacugacucuaagagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacggcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucucugaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguagaaacucuggagcaaaugcaaagaaaacaugggggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5704 - RNA, 9879 nt, Artificial Sequence
  derived and/or modified CDS sequence (wt) from DENV-1__FJ024449__SS-prME
ucugugaccaugcuccuuaugcugaugccuacagccuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacguuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaagaagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggccaaaaucauaggggcagauguacagaacaccaccuucaucaucgauggcccaaacaccccagaauguccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaauuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccagugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaggaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguggggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccucuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugauggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguuuugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucgacauggcauuaugaugaggacaauccauauaaaacaugggccuaucauggaucauaugaugucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaucuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcugaaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5705 - RNA, 9879 nt, Artificial Sequence
  derived and/or modified CDS sequence (wt) from DENV-1__FJ390383__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagauacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaauaaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugaugaaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauacuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuaugucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaauuauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaucccaaauuuagccgagagaguucucgacuggcuggaaaaauauggcgucgaaagacugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5706 - RNA, 9879 nt, Artificial Sequence
  derived and/or modified CDS sequence (wt) from DENV-1__FJ182033__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggaucugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaaguuacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaaccauaacaccucaagcucccacgucggaaauacagcugaccgacuacggagcucuuacauuggacuguucaccuagaacaggacuagacuuuaacgaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguuuuggugcagauuaaauacgaaggaacagaugcaccaugcaagaucccuuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuauuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggauguguaauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaggcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucucagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaaugcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugccguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagaugaaguguuuaggaaaagaaacuuaacaauaauggaccuacauccaggaucggggaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggcugacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagccuuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaaguugccucagaaggcuuccaguacuccgacagaagauggugcuuugacggggaaagaaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcuggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacagcgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcauacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugugaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaguggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacucggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugagcgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucaguagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaagguggugaggguacagagaccagcaagaaauggaaccgugauggaugucauauccagacgugaccagagaggaaguggccaggucggaacuuauggcuuaaacacuuucaccaacauggaagcccagcuaauaagacaaauggagucugagggaaucuuuuuacccagugaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaucaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5707 - RNA, 9879 nt, Artificial Sequence
  derived and/or modified CDS sequence (wt) from DENV-1__FJ182034__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagagcuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuuuuagcacaugccauaggaacauccaucacccagaaagggauuaucuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaguaugaaaacuugaaauauucagugauagucaccguccacacuggagaccagcaccaggugggaaaugaaagcacagaacacgggacaacugcaacuauaacaccucaagcuccuucaacggaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagagacuuggaacagacaagauuugcuugugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacaugcauugcaguuggccuaguaacauuauaccuaggagucaugguucaggcggauucaggauguguaauuaauuggaaaggcagagaacucaaauguggaaguggcauuuuugucaccaaugaaguucacacuuggacagagcaauacaaauuucaagcugacuccccaaagagacuuucagcugccaucgggaaggcaugggaggaggguguguguggaauacgaucagcaacucgucucgagaacaucauguggaagcaaauaucaaaugaacugaaccacaucuuacuugaaaaugacaugaaauucacaguggucguaggagauguugcuggaaucuuggcucaaggaaaaaaaaugauuaggccacaacccauggaauacaaauacucguggaaaagcuggggaaaggcuaaaaucauaggggcagaugugcagaacaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuagcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuuaauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaaugacguaccuagcucugauggccacuuuuaaaaugagaccaauguuagcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguauuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucucauagcagaaaacaaaaucuggggaaggaaaaguuggccccucaaugaaggaaucauggcuguuggaauagucagcauucuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuccaaggauccuggaacacaggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccccuaccagagauugaaaacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaguugagcagaaaaacuuuugauacagaguaccaaaaaacaaaaaauaacgacugggacuacgucgucacaacagacaucucugaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccaggugcuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcaaaccaggcggcuauauuaaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccagcugagcaagucagaauuuaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaauauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauaggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucucucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucgaucuuuaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacagguggccauaaaccaagugagaagacuaauugggaaugagaauuaucuagauuacaugacaucaaugaagagauucaagaacgagagugauccugaaggggcacucugguga

SEQ ID NO: 5708 - RNA, 9879 nt, Artificial Sequence
  derived and/or modified CDS sequence (wt) from DENV-1__FJ182036__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcuggcaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaauccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuauggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacugagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaaugucucagcacaacuacaggccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggagcagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucacucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcaucuuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccugaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggauguuaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccaagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5709 - RNA, 9879 nt, Artificial Sequence
  derived and/or modified CDS sequence (wt) from DENV-1__FJ205876__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacacccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuauuccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccugucaggaaggggccuagggaaaacaucuauuggccuacucugcguaauggcuucaagcguacugcuauggauggccaguguggagccccauuggauagcggccuccaucauacuggaguucuucuugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucaacagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugacagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauaucuagggaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5710 - RNA, 9879 nt, Artificial Sequence
  derived and/or modified CDS sequence (wt) from DENV-1__FJ024455__SS-prME
ucugugaccaugcuccuuaugcugaugccuacagccuuggcguuccauuugacuacacgagggggagagccgcacaugauagucagcaagcaggaaagaggaaagucacucuuguuuaagaccucaguaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaauuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggcccccaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggggaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguagaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5711 - RNA, 9879 nt, Artificial Sequence
  derived and/or modified CDS sequence (wt) from DENV-1__FJ024456__SS-prME
ucugugaccaugcugcuuaugcugaugcccacagccuuggcguuccaucugacuacacgagggggagagccgcauaugauaguuaccaagcaggaaagaggaaagucacuuuuguuuaagaccucagcaggcgucaacaugugcauccuuauagcgauggauuugggagaguuaugugaggacacaaugacuuacaaaugcccucggaucacugaggcggaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguauuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacacaaccuucaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggagagugaaaugguaauuccaaaaaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagcugacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaaccaggcacaucuggaucucccaucgugaauagagaaggaaagauaguaggucuuuauggaaauggaguggugacaacaaguggaaccuacgucagugccauagcucaagccaaagcaucacaagaagguccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaauggaaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuauguacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguugagaggaaccuugugaaaccagaagggaaagucauagaccucggcugcggaagagguggcuggucauacuauugcgcugggcugaagaaagucacagaagugaagggauauacaaaaggaggaccuggcauggaggaaccaaucccaauggcgacuaauggauggaaccuaguaaaacugcacuccgggaaagacguauucuuuacaccaccugagaaaugugacacacuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaaaccaucaggaucagccucauccauggucaauggcguggugaaacugcuuaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaauuuguacaagagaggaguucacaaggaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggccacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaagugagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5712 - RNA, 9879 nt, Artificial Sequence
  derived and/or modified CDS sequence (wt) from DENV-1__FJ024457__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacugucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugucucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaauuuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaagugagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5713 - RNA, 9879 nt, Artificial Sequence
  derived and/or modified CDS sequence (wt) from DENV-1__FJ205881__SS-prME
ucugugaccaugcuccuucugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaagaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaaacaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaacuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5714 - RNA, 9879 nt, Artificial Sequence
  derived and/or modified CDS sequence (wt) from DENV-1__FJ205882__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagagcuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuaucuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucagugauagucaccguccacacuggagaccagcaccaggugggaaaugaaagcacagaacacgggacaacugcaacuauaacaccucaagcuccuucaacggaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagagacuuggaacagacaagauuugcuugugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacaugcauugcaguuggccuaguaacauuauaccuaggagucaugguucaggcggauucaggauguguaauuaauuggaaaggcagagaacucaaauguggaaguggcauuuuugucaccaaugaaguucacacuuggacagagcaauacaaauuucaagcugacuccccaaagagacuaucagcugccaucgggaaggcaugggaugaggguguguguggaauacgaucagcaacucgucucgagaacaucauguggaagcaaauaucaaaugaacugaaccacaucuuacuugaaaaugacaugaaauucacaguggucguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuuggaaaguugaggaccauggauuuggaauuuucccgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuagcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuuaauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuagcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguauuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucucauagcagaaaacaaaaucuggggaaggaaaaguuggccccucaaugagggaaucauggcuguuggaauagucagcauucuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuccaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccccuaccagagauugaaaacgaaguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaguugagcagaaaaacuuuugauacagaguaccaaaaaacaaaaaauaacgacugggacuacgucgucacaacagacaucucugaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccaggugcuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaaaaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcgaaccaggcggcuauauuaaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccagcugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaauauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauaggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucucucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucgaucuuuaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacagguggccauaaaccaagugagaagacuaauugggaaugagaauuaucuagauuacaugacaucaaugaagagauucaagaacgagagugauccugaaggggcacucugguga

SEQ ID NO: 5715 - RNA, 9879 nt, Artificial Sequence
  derived and/or modified CDS sequence (wt) from DENV-1__FJ390388__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggugagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugaugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauagugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaguuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcaaaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaagaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaagaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaguauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5716 - RNA, 9879 nt, Artificial Sequence
  derived and/or modified CDS sequence (wt) from DENV-1__FJ024464__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaauccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuauggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacugagcugguucaagaaaggaagcagcauagggaaaauguuugaggcaacugccagaggaguacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaaugucucagcacaacuacaggccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggagcagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucacucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcaucuuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaaugugcaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccugaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacauaagucaacauggcauuaugacgaggacaauccauauaaaacaugggccuaucauggaucauaugaggucaagccaucaggaucagccucauccauggucaauggcguggugaaacugcucaccaaaccaugggauguuaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccaagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5717 - RNA, 9879 nt, Artificial Sequence
  derived and/or modified CDS sequence (wt) from DENV-1__FJ410191__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaaaaguggagacuugggcccugagacacccaggauucacggugauagcccuuuuucuagcacaugccauaggaacauccaucacccagaaagggauuauuuucauccuguuaaugcugguaacaccauccauggcaaugcgaugugugggaauaggcagcagggacuucguggaaggacugucaggggcaacuuggguagaugugguacuggaacauggaaguugcgucaccaccauggcaaaagacaaaccaacauuggacauugaacucuugaagacggaagucacaaacccugccguccugcguaaauugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguccaacaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaauggugcuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggacgucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaacaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaacuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguaggaguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguucgugaggccauaaaaaggaagcugcgcacauuaauucuggcucccacaaggguugucgcuuccgaaauggcagaggcgcucaagggaaugccaauaagguaccaaacaacagcagugaagggugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauauuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagagagauuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugguacuaugcacaucacaaauccucuugaugcggacuacaugggccuugugugaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauagaagcccagcugauaagacagauggagucugaggaaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgccaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacugauugggaaugagaauuaucuagauuacaugacaucaaugaagagauucaagaacgagagugauccugaaggggcacucugguga

SEQ ID NO: 5718 - RNA, 9879 nt, Artificial Sequence
  derived and/or modified CDS sequence (wt) from DENV-1__FJ432723__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagaugugguacuggaacauggaagcugcgucaccaccauggcgaaagacaaaccaacauuggacauugaacuccugaagacggaagucacaaacccugccguccugcgcaaacugugcauugaagcuaaaauaucaaacaccaccaccgacucaagauguccaacacaaggagaagccacacucauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauacucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccaacauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauacggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauauaaauuucaagcugacuccccaaagagauuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaacuacagaccaggauauuucacacaaacggcagggccguggcaucuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggagcagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauagccacuuuuaaaaugagaccaauguuugcugucgggcuacuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuuuacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggacgaagagagagaugacacgcuaaccauucuccuuaaagcaacucugcuagcaguuucagggguguacccacuaucaauaccagcgacccuuuuugugugguacuuuuggcagaaaaagaaacagagaucuggagugcuaugggauacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaagugggaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauccuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccuaauggugcugcuuauuccagagccagacagacaacgcacuccgcaagacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaucaggcagcuauauugaugggacuugacaaaggauggccaauaucgaagauggacauaggaguuccacuucucgccuuagggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggaggggucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaagucagaauucaacacuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacguguccuaaaaaugguggaaccauggcucagagggaaccaauuuugcauaaaaauucuaaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacauaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacaccacacccuuuggacaacagaggguguucaaagagaaaguugacacgcgcacaccaaaagcaaaacgaggcacagcacaaaucauggaggugacagccaaaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccggcgaauuggagaccccaaauuuagccgagaggguucucgacuggcuggaaaaauauggugucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacugauugggaaugagaauuaucuagauuacaugacaucaaugaagagauucaagaacgagggcgaucccgaaggggcacucugguga

SEQ ID NO: 5719 - RNA, 9879 nt, Artificial Sequence
  derived and/or modified CDS sequence (wt) from DENV-1__FJ410192__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucaugguuaguccacaaacaaugguuuuuagaccuaccacugccuuggaccucgggagcuucaacaucacaagagacuuggaacagacaagaucugcuggugacauuuaagacagcucaugcaaagaagcaggaaguagucgugcuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuuaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagccuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugauacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguucaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccuaaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaaccauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguagaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguucaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaacuuaccaaaauaaggugguaaggguacagagcccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5720 - RNA, 9879 nt, Artificial Sequence
  derived and/or modified CDS sequence (wt) from DENV-1__FJ410194__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaucaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugcccuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuaucggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcccucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugagcccagaauuacugacaucauggaacccgaacaugcccuccuggcuaagucaaucuucaaguuaaccuaccaaaauaaggugguaaggguacagagcccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuggucacaccacuuccaccagcugauuaugaaggaugggagggaaauaguggugccaugccgcaaccaagaugaacuuguggguagggcuagaguaucacaaggugcuggauggagccugagagaaacugcaugccuagccaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5721 - RNA, 9879 nt, Artificial Sequence
  derived and/or modified CDS sequence (wt) from DENV-1__FJ432725__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccauugggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcugggguaacugggggagugacacuuguuuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugccaaaggauggccaauaucgaagauggacauaggaguuccacuucucgccuuggggugcuauucccaggugaauccacugacgcugacagcgccgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacuccgggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaccaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggccaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugggcauagagagagggagcuucacaaacagggaaaaugugcuacguguguuuccaacaugauggggaagagagagaaaaagcuaggagaguucggaaagccaaaaggaagucguccaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagccgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5722 - RNA, 9879 nt, Artificial Sequence
  derived and/or modified CDS sequence (wt) from DENV-1__FJ432729__SS-prME
ucugugacuaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguucugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacuaaacuggaaggaaagauaguucaauaugaaaacuugaaauauucaguaauagucaccguccacacuggagaccagcaccaggugggaaaugaaagcacagaacaugggacaauugcaacuauaacaccccaagcucccacgucggaaauacagcugaccgacuacggagcucucacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagacuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagaucuuuggaaccgcauauggaguuuuguucagcgguguuuccuggaccaugaaaauaggaauagggguucugcugacauggcugggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugagguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauuuacagugguuguaggagauguaguugggaucuuggcucaagggaaaaaaaugaucaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacucccacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaauuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucgauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuagccaugcuucuuauagcagaaaacaaaaucuggggaaggaaaaguuggccccucaaugaaggaauuauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacuuauguaccaagggaagagacuagaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggaaugggugaagcagcugcgaucuucaugacagccacucccccaggaucgguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgcgucauucuagcaggaccgaugccaguaacuguagccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggaucaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagugucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcugugcugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacagcuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaauccuuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguuacuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguagugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccagaauuacugacaucauggagcccgaacaugcccuacuggcuacgucaaucuuuaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugaaggaaucuuuuuacccagcgaauuggagacccaaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggcuuccaacauacaaguggccauaaaccaagugagaagacuaauugggaaugagaauuaucuagauuacaugacaucaaugaagagauucaagaacgagggugaucccgaaggggcacucugguga

SEQ ID NO: 5723 - RNA, 9879 nt, Artificial Sequence
  derived and/or modified CDS sequence (wt) from DENV-1__FJ432730__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaaugacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguuuagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcgacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggccaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuguuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguucuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguagagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuugacaauaauggaccuacauccaggaucggggaaaacaagaagauaucuuccagccauaguccgugaggccauaaaaaggaagcugcgcacauuaauucuggcucccacaagaguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguauaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacguacucagacccacuggcccugcgcgaguuuaaagaguuugcagcaggaagaagaagcgucucaggugaucuaauauuagaaauagggaaacuuccacaacaccugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuagggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccaggagaguucuugacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccaguugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggugcacucugguga

SEQ ID NO: 5724 - RNA, 9879 nt, Artificial Sequence
  derived and/or modified CDS sequence (wt) from DENV-1__FJ432732__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaagggauuauuuucauuuugcuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaagugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauaguuacugacaaagaaaaaccagucaacauugaggcagaaccgcccuuuggugagaguuacaucacaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuucuuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauuuuacuugaaaaugauaugaaauucacagugguuguaggagauguugcugggaucuuugcucaaggaaagaaaaugauuaggccacaacccauggaauacaaauacucauggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugcuaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccucuuaaugaaggaaucauggcuguuggaauagucagcauccuacuaaguucacuccuaaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacauccggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccguuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcucugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggcccugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacguuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcuaauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagguucaagaacgagagugaucccgaaggggcacucugguga

SEQ ID NO: 5725 - RNA, 9879 nt, Artificial Sequence
  derived and/or modified CDS sequence (wt) from DENV-1__FJ432733__SS-prME
ucugugacuaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugagguggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguucugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacuaaacuggaaggaaagauaguucaauaugaaaacuugaaauauucaguaauagucaccguccacacuggagaccagcaccaggugggaaaugaaagcacagaacaugggacaauugcaacuauaacaccccaagcucccacgucggaaauacagcugaccgacuacggagcucucacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagacuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagaucuuuggaaccgcauauggaguuuuguucagcgguguuuccuggaccaugaaaauaggaauagggguucugcugacauggcugggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugagguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauuuacagugguuguaggagauguaguugggaucuuggcucaagggaaaaaaaugaucaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacucccacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaauuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucgauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuagccaugcuucuuauagcagaaaacaaaaucuggggaaggaaaaguuggccccucaaugaaggaauuauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaacauauuaguggagguccaagaugauggaacuaugaagauaaaggaugaagagagagaugauacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacuuauguaccaagggaagagacuagaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggaaugggugaagcagcugcgaucuucaugacagccacucccccaggaucgguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgcgucauucuagcaggaccgaugccaguaacuguagccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggaucaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagugucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcugugcugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacagcuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaauccuuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguuacuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguagugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccagaauuacugacaucauggagcccgaacaugcccuacuggcuacgucaaucuuuaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugaaggaaucuuuuuacccagcgaauuggagacccaaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggcuuccaacauacaaguggccauaaaccaagugagaagacuaauugggaaugagaauuaucuagauuacaugacaucaaugaagagauucaagaacgagggugaucccgaaggggcacucugguga

SEQ ID NO: 5726 - RNA, 9879 nt, Artificial Sequence
  derived and/or modified CDS sequence (wt) from DENV-1__FJ410196__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauaugguugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucugggagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauucaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucguuacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaagugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagaggcauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5727 - RNA, 9879 nt, Artificial Sequence
  derived and/or modified CDS sequence (wt) from DENV-1__FJ432734__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuuggguccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugccgacgaacguuuguggacagaggcuggggcaauggcugugggcuuuucggaaaaggaagccuaauaacgugugcuaaguuuaagugugugacaaaacuggaaggaaagauaguccaauaugaaaacuugaaauacucaguaauagucacuguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucgcaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcagauucaggauguguaauuaacuggaaagguagagaacucaaauguggaaguggcauuuuugucaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauguucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguuuuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcugugcucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcggcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgauagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcuguaaacaugacaucuagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucaguagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuggccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagacugaucccgaaggggcacucugguga

SEQ ID NO: 5728 - RNA, 9879 nt, Artificial Sequence
  derived and/or modified CDS sequence (wt) from DENV-1__FJ432735__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacuguguauugaagcuaaaauaucaaacaccaccacugauucaagauguccaacacaaggagaagccacacugguggaagaacaagacgcgaacuuugugugucgacgaacguuuguggauagaggcuggggcaauggaugugggcucuucggaaaaggaagccuaauaacgugugcuaaguucaaguguguaacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucaacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaaucuuugcaggacacuugaaauguagacuaaagauggacaagcugacucuaaaagggaugucauauguuaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacaucugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguugugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaucaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacgacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggagaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggcgaucuaauauuagaaauagggaaacuuccacaacacuugacgcaaaaggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccacuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaauaagaaaccgagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuugugggcagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5729 - RNA, 9879 nt, Artificial Sequence
  derived and/or modified CDS sequence (wt) from DENV-1__FJ432736__SS-prME
ucugugaccaugcuccuuaugcugaugcccacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucgggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucaugcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauaucucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggccaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuucgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaauauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaucuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggccaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaucaggcagcuauauugaugggacuugacaaaggauggccaauaucgaagauggacauagggguuccacuucucgcuuuggggugcuacucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucccuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacacgcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcagcaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacagaagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5730 - RNA, 9879 nt, Artificial Sequence
  derived and/or modified CDS sequence (wt) from DENV-1__FJ410198__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagcuuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggugauguugcugggaucuuggcucaaggaaagaaaaugaucaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggauagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagauuuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccucuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccuaguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccacaaugcuggauguagacuuacauccagcuucagccuggacccucuaugcaguggccacaacaauuauuacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggcuggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauuaaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaagccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaauacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccagcuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5731 - RNA, 9879 nt, Artificial Sequence
  derived and/or modified CDS sequence (wt) from DENV-1__FJ410199__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaacagaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaagggguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaucaccggcuaaugucagcugccaucaaggacagcaaggcaguucacgcugacaugggguacuggauagaaagugaaaagaacgagaccuggaagcuggcaagagccuccuucauagaaguuaaaacauguaucuggccaaagucccacacucuauggagcaauggaguucuggaaagugaaaugauaauuccaaagaacuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcugugcucuuccuucucauaaugggacaauugacauggagugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacaacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaaccuaacaauaauggaccuacauccaggaucggggaaaacaagaaaauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccuuaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacuccuccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaagcuuccacaacacuugacgcaaagggcccagaacgccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacguugacagcggcgguguugaugcuaguggcucauuacgccauaauuggaccuggacugcaagcaaaagcuacuagagaagcucaaaaaaggacagcggccggaauaaugaagaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaccuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucaucuauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguuuacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaagagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaaguuagaagacuaauugggaaugagaauuaucuagauuacaugacaucaaugaagagauucaagaacgagagugauccugaaggggcacucugguga

SEQ ID NO: 5732 - RNA, 9879 nt, Artificial Sequence
  derived and/or modified CDS sequence (wt) from DENV-1__FJ432739__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuuaggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacgagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaagcauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauaccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaucagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucauggaaaagcuggggaaaggcuaaaaucauaggggcagaugugcagaaugccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaauacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcauuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauugguggagguccaagaugauggaaccaugaagauaaaggaugaagagagagaugacacgcuaaccauucuccugaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuucugucucccgugagaguucccaauuacaacaugauuaucauggaugaagcacauuucaccgauccauccagcauagcggccagaggguacaucucaacccgaguggguaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaauaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagcuuauagacaugcaauggaggaacugccagacaccauagaaacguugaugcuccuagcuuugauagcuguguuaacugguggagugacgcuguucuuccuaucagggaggggccuagggaaaacaucuaucggccuacucugugugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauuuaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuugggguguuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugauacaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcggucuccauggcaaacauuuuuagaggaaguuaucuagcaggagcaggucuggccuucucauuaaugaaaucucuaggaggagguaggagagguacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaguuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagauugauccugaaggggcacucugguga

SEQ ID NO: 5733 - RNA, 9879 nt, Artificial Sequence
  derived and/or modified CDS sequence (wt) from DENV-1__FJ410201__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaaaauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacucgaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccaggaaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugccuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcccaaggggaaacacugggagaaaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacguacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcucaucaccaauggaugacaacagaagacaugcugucaguguggaauaggguuuggauagaggaaaacccauggauggaggacaaaacccauauauccagcugggaagauguuccauauuuagggaaaagggaagaccaaugguguggaucccugauaggcuuaacagcaagggccaccugggccaccaacauacaaguggcuauaaaccaagugagaagacuaauugggaaugagaauuaucuaaauuacaugacaucaaugaagagauucaagaacgagagugauccugaaggggcacucugguga

SEQ ID NO: 5734 - RNA, 9879 nt, Artificial Sequence
  derived and/or modified CDS sequence (wt) from DENV-1__FJ410203__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacaugcucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcuaaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuucgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaauauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcagucauccaagaugaggaaagagacauuccugagagaucauggaacucaggccaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuacucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucccuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugagucuucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacacgcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcagcaagugccuuuuuguucacaccacuuccaccagcugauuaugaaggaugggagggaaauaguggugccaugccgcaaccaagaugaacuuguggguagggcuagaguaucacaaggugcuggauggagccugagggaaacugcaugccuaggcaaaucauaugcacaaauguggcagcugauguacuuccacagaagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5735 - RNA, 9879 nt, Artificial Sequence
  derived and/or modified CDS sequence (wt) from DENV-1__FJ410204__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacaugcucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcuaaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguuuauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuucgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaauauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcagucauccaagaugaggaaagagacauuccugagagaucauggaacucaggccaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaacaaagaaacuacgacaccgcuggccggaugccagacaauacucagacccacugggccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuacucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucccuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugagucuucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacacgcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcagcaagugccuuuuuguucacaccacuuccaccagcugauuaugaaggaugggagggaaauaguggugccaugccgcaaccaagaugaacuuguggguagggcuagaguaucacaaggugcuggauggagccugagggaaacugcaugccuaggcaaaucauaugcacaaauguggcagcugauguacuuccacagaagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5736 - RNA, 9879 nt, Artificial Sequence
  derived and/or modified CDS sequence (wt) from DENV-1__FJ432742__SS-prME
ucugugaccaugcuucuuaugcugaugcccacagccuuggcguuccaucugacuacacgagggggagagccgcauaugauagucaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggaucauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacaggcaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuagcuguuuuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuuguaugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacauacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugcugcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuagacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacaggcaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagacuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcuguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaccccgaaggggcacucugguga

SEQ ID NO: 5737 - RNA, 9879 nt, Artificial Sequence
  derived and/or modified CDS sequence (wt) from DENV-1__FJ410205__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaaguuacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucugcuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauauaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucacuaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcgaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucauaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagcugagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5738 - RNA, 9879 nt, Artificial Sequence
  derived and/or modified CDS sequence (wt) from DENV-1__FJ410207__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucauggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugugucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaacuagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagugguguuuccuggaccaugaaaauaggaauaggaguucugcuaacauggcuaggauuaaacucaaggagcacgucccuuucgaugacaugcauugcaguuggccuaguaacauuauaccuaggagucaugguccaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuucaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacagaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagggcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugagccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcucuuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggauugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacaguugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauauuauugcgccgggcugaagaaagucacagaagugaagggauauacgaaaggaggaccuggacaugaggagccaauuccaauggcgaccuauggauggaaccuaguaaaacugcacuccgggaaagacguauucuuuacaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacgugugucuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuucuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5739 - RNA, 9879 nt, Artificial Sequence
  derived and/or modified CDS sequence (wt) from DENV-1__FJ432744__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuuaggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacgagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaauuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaagcauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauaccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaucagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucauggaaaagcuggggaaaggcuaaaaucauaggggcagaugugcagaaugccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaauacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcauuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauugguggagguccaagaugauggaaccaugaagauaaaggaugaagagagagaugacacgcuaaccauucuccugaaagcaacucugcuagcagucucagggguguacccauuaucaauaccagcgacccuuuuugugugguacuuuuggcagaaaaagaaacggagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuucugucucccgugagaguucccaauuacaacaugauuaucauggaugaagcacauuucaccgauccauccagcauagcggccagaggguacaucucaacccgaguggguaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaauaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagcuuauagacaugcaauggaggaacugccagacaccauagaaacguugaugcuccuagcuuugauagcuguguuaacugguggagugacgcuguucuuccuaucagggaggggccuagggaaaacaucuaucggccuacucugugugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauuuaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuugggguguuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugauacaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcggucuccauggcaaacauuuuuagaggaaguuaucuagcaggagcaggucuggccuucucauuaaugaaaucucuaggaggagguaggagagguacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaguuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagauugauccugaaggggcacucugguga

SEQ ID NO: 5740 - RNA, 9879 nt, Artificial Sequence
  derived and/or modified CDS sequence (wt) from DENV-1__FJ547060__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggauacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuucaaugaaaugguguuguugacaaugaaagaaaaaucauggcuaguccauaaacaaugguuucuagaccuaccacugccuuggaccucaggagcuucaacaucgcaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguuuaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagucaugguucaggcggauucaggauguguaauuaauuggaaagguagagagcuaaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauauggcugaaauugcgugacucuuacacccaagugugugaccaucggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaucuagcucugauggccacuuuuaaaaugagaccaauguuugcugucgggcuauuauuccguagacuaacauccagagaaguucuccuucucacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuaucaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaauuuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcaccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaaaccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcuccuacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaggcagcugcgaucuucaugacagccacucccccaggaucaguggaggccuuuccacagagcaaugcaguuauccaagaugaggaaagagacauuccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccaaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuccgaccccgcuggcuggaugccagaacauacucagacccacuggcccugcgcgaguuuaaagaguuugcagcaggaagaagaagcgucucaggugaucuaauauuagaaauagggaaacuuccacaacauuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcgguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgcgaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauucccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaguaagacaaauggagucugagggaaucuuuucacccugcgaauuggagauuccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggcaaccugggccucuaacauacaaguggccauaaaccaagugagaagacuaauugggaaugagaauuaucuagauuacaugacaucaaugaagagauucaagaacgagggugaucccgaaggggcacucugguga

SEQ ID NO: 5741 - RNA, 9879 nt, Artificial Sequence
  derived and/or modified CDS sequence (wt) from DENV-1__FJ432745__SS-prME
ucugugaccaugcuccuuaugcugaugccuacagccuuggcguuccauuugacuacacgagggggagagccgcacaugguagucagcaagcaggaaagaggaaaaucacucuuguucaagaccucagcaggugucaacauguguacccuuauagcgauggauuugggagaguuaugugaggacacaaugacuuacaaaugcccucgaaucacugaagcugaaccagaugacguugacuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagaccuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccaguuaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggauuagggguucugcugacauggcuaggauuaaacucaaggagcacgucccuuucgaugacgugcauugcaguuggccuaguaacacuauacuuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccauugggaaggcaugggaggaggguguguguggaauucgaucagcaacucgucucgagaacgucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagcgaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucuuauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccaccuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaaguauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuucuuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccaugcggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggacccggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucaguagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggagcccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaagugagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaccccgaaggggcacucugguga

SEQ ID NO: 5742 - RNA, 9879 nt, Artificial Sequence
  derived and/or modified CDS sequence (wt) from DENV-1__FJ432746__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauccuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguccaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggggcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggagugacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcggcguuuccuggaccaugaaaauaggaauaggaguucugcugacauggcuaggauuaaacucaaggagcacgucccuuucgaugacgugcauugcaguuggccuaguaacuuuauaccuaggagucaugguucaggcggauucaggauguguaauuaauuggaaagguagagaacucaaauguggaaguggcauuuuugucacuaaugaaguucacacuuggacagagcaauacaaauuucaagcugacuccccaaagagacuaucagcagccaucgggaaggcaugggaggaagguguguguggaauacgaucagcaacucgucuugagaacaucauguggaagcaaauaucaaaugaacugaacuacaucuuacuugaaaaugacaugaaacucacagugguuguaggagauguugcuggaaucuuggcucaaggaaaaaaaaugauuaggccacaacccauggaguacaaauacucguggaaaagcuggggaaaagcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacaccaaggcaguucacgcugacaugggguacuggauagaaagugaaaagaacgagaccuggaaguuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugauuuucaaucacaucaguugugggcuaccuugcuguccuugacauuugucagaacaacguuuucccugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcuguggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaaccaggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguauaucucaacccgagugggcaugggugaggcagcugcgaucuucaugacagccacuccuccaggaucaguggaggccuuuccacagagcaacgcagucauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaguugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaccaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaagaaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccauuauacuggaguucuuccugauggugcugcuuauuccagagccagacagacaacgcacuccgcaggacaaccagcuggcauauguggugauagguuuauuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucucugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcuaaagcuaccagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagcuacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugagucuucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauacgaaagagacguggaucuaggcgccggaacaagacauguggcaguggaaccagagguagccaaccuagauaucauuggccagaggauagagaacauaaaacaugaacauaagucaacauggcauuaugaugaggacaauccauauaaaacaugggccuaccauggaucauaugaggucaagccgucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucauaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuuuaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagagacugcaugccuaggcaagucauaugcacaaauguggcagcugauguacuuucacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5743 - RNA, 9879 nt, Artificial Sequence
  derived and/or modified CDS sequence (wt) from DENV-1__FJ432748__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguugugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuuuuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaaggucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucaaaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggagguaaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggauacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaauaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugcugcucagaggagaggaagaauuggaaggaaccacaauaaggaaggugaucaguacaucuacaugggacagccuuuaaacaacgaugaagaucacgcucacuggacagaagcaaaaaugcuccuugacaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5744 - RNA, 9879 nt, Artificial Sequence
  derived and/or modified CDS sequence (wt) from DENV-1__FJ432749__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggugagcaccgacgagacaaacguuccgucgcacuggccccacacgugggacuugguuuggaaacaagaaccgaaacguggauguccucugaaggcgcuuggaaacagauacaaagaguggaaacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaaccgcaacuauaacaccucaagcucccacaucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaggauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaucugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuuugacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaguguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaaacaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagagagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccauggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuugcacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccccuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuggcaguuucagggguguacccauuaucaauaccagcgacccuuuuugugugguacuuuuggcagaaaaagaaacagagaucuggagugcuaugggacacaccuagcccuccagaaguggaaaaagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcguacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaaguaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacugaaagauggcccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauuaccagacaccauagaaacguugaugcuccuagcuuugauagcuguguugacugguggagugacgcuguucuuccuaucaggaaggggccuagggaaaacaucuaucggcguacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuguucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaauauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagaucugaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaggugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaaucuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuccacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaacaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacagguggccauaaaccaagugagaagacuaauugggaaugagaauuaucuagauuacaugacaucaaugaagagauucaagaacgagggugaucccgaaggggcauucugguga

SEQ ID NO: 5745 - RNA, 9879 nt, Artificial Sequence
  derived and/or modified CDS sequence (wt) from DENV-1__FJ410212__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguggagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucgacaucacaagagacuuggaauagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauaggggcucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauccauggaggaccaauaucucagcacaacuacagaccaggauauuucacacaaacggcagggccguggcaccuaggcaaguuggaauuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaguugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacacuaaccauccuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgagauggcagaagcgcucaagggaaugccaauaagguaccaaacaacagcagugaagagugaacacacaggaaaagagauaguugaccucaugugucacgcuacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagaguaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacagacaucuccgaaaugggagcaaauuuccgggccgacagggugauagacccaagacggugucugaaaccgguaauauuaaaagaugguccagagcgugucauuuuggcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccggagagagaaaagagugcagcaauagacggggaauauagacugaggggugaagcaaggaaaacguuuguggagcucaugagaagaggagaccuacccgucuggcuguccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggauggccaguguggagccccauuggauagcggccucuaucauacuggaguucuuccuaaugguguugcuuauuccagagccagacagacaacgcacuccgcaggacaaccagcuggcauauguggugauaggucuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauugucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugugaauccaucacacuggccacuggaccucugaccacgcuuugggagggaucuccaggaaaauuuuggaacaccacgauagcgguuuccauggcaaacauuuuuagaggaaguuaucuagcaggagcagguuuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuucauaccaccugagaaaugugauacccuuuugugugauauuggugaguccucuccaaacccaacuauagaggaaggaagaacgcuacgcguucuaaagaugguggaaccauggcucagaggaaaccaauuuugcauaaagauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggggaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaauuuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagucugagagaaacugcaugccuaggcaagucauaugcacaaauguggcagcugauguacuuccacaggagagaccugagacuagccgcuaaugcuaucuguucagccguuccagucgacugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 5746 - RNA, 9879 nt, Artificial Sequence
  derived and/or modified CDS sequence (wt) from DENV-1__FJ461307__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguggagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucgacaucacaagagacuuggaauagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaauauugaggcagaaccgccuuuuggugagaguuacaucgugauaggagcaggugaaaaagcuuugaaacuaagcugguucaagaaaggaaguagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguaucuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauccauggaggaccaauaucucagcacaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaguugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacacuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgagauggcagaagcgcucaagggaaugccaauaagguaccaaacaacagcagugaagagugaacacacaggaaaagagauaguugaccucaugugucacgcuacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagaguaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacagacaucuccgaaaugggagcaaauuuccgggccgacagggugauagacccaagacggugucugaaaccgguaauauuaaaagaugguccagagcgugucauuuuggcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccggagagagaaaagagugcagcaauagacggggaauauagacugcggggugaagcaaggaaaacguuuguggagcucaugagaagaggagaccuaccugucuggcuguccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggauggccaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugugaauccaucacacuggccacuggaccucugaccacgcuuugggagggaucuccaggaaaauuuuggaacaccacgauagcgguuuccauggcaaacauuuuuagaggaaguuaucuagcaggagcagguuuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguucguggagaggaaccuugugaaaccagaagggaaagucauagaccuugguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuucauaccaccugagaaaugugauacccuuuugugugauauuggugaguccucuccaaacccaacuauagaggaaggaagaacgcuacgcguucuaaagaugguggaaccauggcucagaggaaaccaauuuugcauaaagauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggggaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuugcccaacgaauuagagaccccaaaucuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugauaucaaugaagagauucaagaacgagagugaacccgaaggggcacucugguga

SEQ ID NO: 5747 - RNA, 9879 nt, Artificial Sequence
  derived and/or modified CDS sequence (wt) from DENV-1__FJ410213__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggaucauuuucauuuuguuaaugcugguaacaccauccauggccaugcgaugcgugggaauaggcagcagggacuucguggaaggacugucaggagcaacuuggguagacguaguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucaugguuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaacgggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguugugggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauccuacuaaguucacuccucaaagaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagcuauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagauauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaucaaaaaacaaaaaauaacgauugggacuaugucguuacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauuaccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacaggcaacgcacuccgcaggacaaucagcuggcguauguggugauagguuuguuauucaugauacugacaguagcagccaaugagaugggacuacuggaaacuacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagauuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgcuaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5748 - RNA, 9879 nt, Artificial Sequence
  derived and/or modified CDS sequence (wt) from DENV-1__FJ461308__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauugcuggugcaaugccacagacacaugggugaccuauggaacauguucccaaacuggcgagcaccgacgcgacaaacguuccgucgcacuggccccacacgugggacuugguuuggaaacaagagccgaaacguggauguccucugaaggcgcuuggaaacagauacaaagaguggagacuugggcccugagacacccaggauucacggugauagcccuuuuucuagcacaugccauaggaacauccauuacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaagggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguugcaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaacuaguacaccagauuuuuggaacugcauauggaguuuuguucagcgguguuuccuggacuaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguagcuggaaucuuggcucaaggaaaaaaaaugauuaggccacaacccauggaacacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacgcuucaaaggagaggaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccuuuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccucuugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccgggcaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaccaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacaccugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguugcggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucgagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguuugaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5749 - RNA, 9879 nt, Artificial Sequence
  derived and/or modified CDS sequence (wt) from DENV-1__FJ461310__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaagcugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaucuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaauaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccauugggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaagcuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagagaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauagaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugcugcaaugcuggacguagacuuacauccagcuucagccuggacccucuaugcaguggccacaacaauuaucacucccaugaugaggcacacaaucgaaaacacaacggcaaacauuucccugacagccauugcaaaucaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcgguguucguugaugaaaaucaauggaacucggcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagacuacaugacaucaaugaagagauucaagaacgagagugaucccgaaggggcacucugguga

SEQ ID NO: 5750 - RNA, 9879 nt, Artificial Sequence
  derived and/or modified CDS sequence (wt) from DENV-1__FJ906728__SS-prME
ucugugaccaugcuccuuaugcugaugccuacagccuuggcguuccauuugacuacacgagggggagagccgcacaugauagucagcaagcaggaaagaggaaagucacuucuguucaagaccucagcaggugucaacaugugcacccuuauagcgauggauuugggagaguuaugugaggacacaaugacuuacaaauguccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaaaauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuauauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcccauucaagcuagagaaagaaguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaaaaaaaugauuaggccacaacccauggaauauaaauacucguggaaaagcuggggaaaggcuaaaaucauaggggcagaugcacagaacaccaccuucauuaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucauucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaggagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuacuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgaacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacacaggcuaugaguggaucaccgacuucccaggcaaaacaguuugguuuguuccaagcauuaaaucaggaaaugacauugccaacugccuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacuggcaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcccaaggggaaacacugggagaaaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaaugaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaccaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5751 - RNA, 9879 nt, Artificial Sequence
  derived and/or modified CDS sequence (wt) from DENV-1__FJ461313__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagccaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaaaaaaaugauuaggccacaacccauggaauauaaauacucauggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaggaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauagcucuagauuuuaaacccggcacaucuggaucucccaucgugaacagagaaggaaaaauaguaggucuuuauggaaauggaguagugacaacaaguggaaccuacgucagugccauagcccaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuacucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaagcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacagaaaaccaacauaugaaagagacguggaccuaggcacuggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucaauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5752 - RNA, 9879 nt, Artificial Sequence
  derived and/or modified CDS sequence (wt) from DENV-1__FJ547063__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucaugguuaguccacaaacaaugguuuuuagaccuaccacugccuuggaccucgggagcuucaacaucacaagagacuuggaacagacaagaucugcuggugacauuuaagacagcucaugcaaagaagcaggaaguagucgugcuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuuaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagccuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugauacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguucaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccuaaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuucaaagaaauucuacucaugaaauguauugggucucauguggaacaggaaacauugugucagcaguaaacaugacaucuagaauguugcuaaaucgauucacaauggcucacaggaaaccaacauaugaaagagacguggaccuaggcgccggaacaagacauguggcaguagaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaacuuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5753 - RNA, 9879 nt, Artificial Sequence
  derived and/or modified CDS sequence (wt) from DENV-1__FJ410218__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggauacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuucaaugaaaugguguuguugacaaugaaagaaaaaucauggcuaguccacaaacaaugguuucuagaccuaccacugcccuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguuuaagaaaggaaguagcauagggaaaauguuugaggcaacugccagaggagcacgaagaauggccauacugggggacaccgcaugggacuuugguuccauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacucaagugugugaccaucggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguagaugaacauuguggaaaucgaggaccaucucuuagaaccacaacagucacaggaaagauaauucaugaaugguguugcagaucuugcacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucucacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuaucaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaguagaaaauaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagccguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcaccgggcaccuucaagaccccugaaggugaaguuggagccauugcccuagauuuuaaacccggcacaucuggaucuccuauagugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcuccuacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaggcagcugcgaucuucaugacagccacucccccaggaucaguggaggccuuuccacagagcaaugcaguuauccaagaugaggaaagagacaucccugagagaucauggaacucaggauaugaguggaucacugacuuuccagguaaaacagucugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccaaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaccuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuccgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacacuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucacuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgcgaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguugcgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuuggauucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuucacccagcgaauuggagaucccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggcaaccugggccucuaacauacaaguagccauaaaccaagugagaagacuaauugggaaugagaauuaucuagauuacaugacaucaaugaagagauucaagaaugagggugaucccgaaggggcacucugguga

SEQ ID NO: 5754 - RNA, 9879 nt, Artificial Sequence
  derived and/or modified CDS sequence (wt) from DENV-1__FJ461316__SS-prME
ucugugaccaugcuccuuaugcugaugccuacagccuuggcguuccauuugacuacacgagggggagagccgcacaugguagucagcaagcaggaaagaggaaaaucacucuuguucaagaccucagcaggugucaacaugugcacccuuauagcgauggauuugggagaguuaugugaggacacaaugacuuacaaaugcccucgaaucacugaagcugaaccagaugacguugacuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagaccuggaacagacaagauuugcuggugacauuuaagacagcucaugcaaagaagcaggaaguagucgugcuaggaucacaagaaggagcaaugcacacugcguugaccggagcaacagaaauccaaacgucaggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggauuagggguucugcugacauggcuaggauuaaacucaaggagcacgucccuuucgaugacgugcauugcaguuggccuaguaacacuauacuuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacgucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucaugggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagagguucuucuucuaacaauuggauugagucuaguggcaucuguggaguuaccaaauuccuuggaggagcugggggauggacuugcaaugggcauuaugauuuuaaaauuauugacagacuuucaaucacaucagcugugggccaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauccuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccccuaccagagauugaagacgagguguuuaggaaaagaaacuugacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccuauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaaguauuaaaucaggaaaugacauagccaacugccuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacgaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugcccuggacaaccugguuauguugcacaacuccgaacaaggaggaagagccuacagacaugcaauggaagaacugccagacaccauagaaacguugaugcuccuagcuuugauagcuguguuaacugguggagugacacuguucuucuuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccaugcggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccccugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacaguugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcuggguugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaagugagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacauguugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5755 - RNA, 9879 nt, Artificial Sequence
  derived and/or modified CDS sequence (wt) from DENV-1__FJ410220__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguggagacuugggcccugagacacccaggauucacggugauagcccuuuuucuagcacaugccauaggaacaucuaucacccagaaagggauuguuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucgacaucacaagagacuuggaauagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauccauggaggaccaauaucucagcacaacuacagaccaggauauuucacacaaacggcagggccguggcaccuaggcaaguuggaacuggauuuugauuugugugaggguaccacagucguaguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaguugacauggaaugaucugaucagauuaugcaucaugguuggagccaacgcuuccgauagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacacuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaaggaacuuaacaauaauggaccuacauccaggaucggggaaaacaagaagauaucuuccagccauaguccgugaggccauaaaaaggaagcugcgcacacuaauucuggcucccacaaggguugucgcuuccgagauggcagaagcgcucaagggaaugccaauaagguaccaaacaacagcagugaagagugaacacacaggaaaagagauaguugaccucaugugucacgcuacuuucaccaugcgccuccugucucccguuagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagaguaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacagacaucuccgaaaugggagcaaauuuccgggccgacagggugauagacccaagacggugucugaaaccgguaauauuaaaagaugguccagagcgugucauuuuggcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccggagagagaaaagagugcagcaauagacggggaauauagacugcggggugaagcaaggaaaacguuuguggagcucaugagaagaggagaccuaccugucuggcuguccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaaaggccuagggaaaacaucuaucggccuacucugcgugauggcuucaagcguacuacuauggauggccaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggauauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugugaaucuaucacacuggccacuggaccucugaccacgcuuugggagggaucuccaggaaaauuuuggaacaccacgauagcgguuuccauggcaaacauuuuuagaggaaguuaucuagcaggagcagguuuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuucauaccaccugagaaaugugauacccuuuugugugauauuggugaguccucuccaaacccaacuauagaggaaggaagaacgcuacgcguucuaaagaugguggaaccauggcucagaggaaaccaauuuugcauaaagauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggggaaggacuucacaaacuuggauauauacucagagacauaucaaagauuccaggaggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaauuuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 5756 - RNA, 9879 nt, Artificial Sequence
  derived and/or modified CDS sequence (wt) from DENV-1__JF937649__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaacaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguucguggacagaggcuggggcaauggcugugggcucuucggaaaaggaagccugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguuuuagugcagauuaaauacgaaggaacagaugcaccaugcaagaucccuuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggcgaaaaagcuuugaaacuaagcugguucaagaaaggaagcagcauagggaaaauguuugaggcaacugccagaggagcacgaaggauggccauauugggagauaccgcaugggacuuugguucuauaggaggaguguucacgucuguuggaaaacuaguacaccagauuuuuggaacugcauauggaguuuuguucagcgguguuuccuggaccaugaagauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauuacgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacaugcaucuggccaaaaucccacacccuauggagcaauggaguucuggaaagugaaaugauaauuccaaaaaucuauggaggaccaauaucucagcacaacuauagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaucuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucagucauaucagcugugggcuaccuugcuguccuugacauuuaucaaaacaacguuuuccuugcacuaugcauggaagacaauggcuaugguauugucaauuguaucucuccuccccuuaugccuguccacgaccucccaaaaaacaacauggcucccggugcuauugggaucucuuggaugcaaaccacuaaccauguuucuaauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacauaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaagaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaagacaaaaaauaacgacugggacuacgucguuacaacagacaucuccgaaaugggagcaaacuuccgggcugacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaagucgccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauacuagaaauagggaaacuuccacaacacuugacgcaaagggcccagaaugcuuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuucuaucaggaaagggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauuuaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggauaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagcuggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuuauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugauccugaaggggcacucugguga

SEQ ID NO: 5757 - RNA, 9879 nt, Artificial Sequence
  derived and/or modified CDS sequence (wt) from DENV-1__FJ410222__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuauggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacugagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacaggccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggagcagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucacuccucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcaucuuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguauuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccugaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaaucacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccaagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5758 - RNA, 9879 nt, Artificial Sequence
  derived and/or modified CDS sequence (wt) from DENV-1__FJ461319__SS-prME
ucugugaccaugcuccuuaugcugaugccuacagccuuggcguuccauuugaccacacgagggggagagccgcacaugguagucagcaagcaggaaagaggaaaaucacucuuguucaagaccucagcaggugucaacauguguacccuuauagcgauggaucugggagaguuaugugaggacacaaugacuuacaaaugcccucgaaucacugaagcugaaccagaugacguugacuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagaccuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggauuagggguucugcugacauggcuaggauuaaacucaaggagcacgucccuuucgaugacgugcauugcaguuggccuaguaacacuauacuuaggagucaugguucaggcggauucaggauguguaauuaauuggaaagguagagaacucaaauguggaaguggcauuuuugucaccaaugaaguccacaccuggacagagcaauacaaauuucaagcugacuccccaaagagacuaucagcagccaucgggaaggcaugggaggaggguguguguggaauucgaucagcaacucgucucgagaacgucauguggaagcaaauaucaaaugaacugaaucacaucuuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccacuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccaccuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaaguauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuucuuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccaugcggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccgcaggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaagagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucaguagagagaauucacucagcggaguggaaggagaaggacuccacaaacuuggauauauacucagagacauaucaaagauuccagggggaaacauguaugcagaugacacagccggaugggacacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaagugagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacguacaaguggccauaaaccaagugagaagacuaauugggaaugagaauuaccuagauuacaugacaucaaugaagagauucaagaacgagagugaucccgaaggggcacucugguga

SEQ ID NO: 5759 - RNA, 9879 nt, Artificial Sequence
  derived and/or modified CDS sequence (wt) from DENV-1__FJ461320__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacuuuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggacccauaucucagcacaacuacagaccaggauacuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacggcauggaaaucagaccaguuaaggaaaaggaagagaaucuagucaaaucaauggucuccgcagggucaggggaaguggacagcuucucacuaggacugcuaugcauaucaauaauggucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaauaagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaccagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauucuacuaaguucacuccuuaaaaaugaugugccgcuagcugggccacuaauagcuggaggcaugcuaauagcguguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcagaucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucagggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuauuauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaaggggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguggcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacgacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccuuugaccacgcuuugggagggaucuccaggaaaauuuuggaacaccacgauagcgguuuccauggcaaauauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaggagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaaggaagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuacggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcacuaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5760 - RNA, 9879 nt, Artificial Sequence
  derived and/or modified CDS sequence (wt) from DENV-1__FJ410225__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuauuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucgaaugaacugaaucacaucuuacuugaaaaugauaugaaauucacagugguuguaggagauguugcugggaucuuggcucaaggaaagaaaaugauuaggccacaacccauggaauacaaauauucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucauuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugagaucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccgcaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5761 - RNA, 9879 nt, Artificial Sequence
  derived and/or modified CDS sequence (wt) from DENV-1__FJ410226__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuagaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagaugcccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuccuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggauaagcugacucuaaaggggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagacaaaccagucaacauugaggcagaaccgccuuuuggugagagcuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguuuacgucuguuggaaaauuaguacaccagauuuuuggaacugcauauggaguuuuguucagcgguguuucuuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaguuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgccgacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaacugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaagugcuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugcauguccacaaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccguuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagacgacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaggaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacacccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagaguaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacgucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaauuugguuauguugcacaacuccgaacaaggaggaagagccuauagacacgcaauggaggaauugccagacaccauagaaacguugaugcuccuagcuuugauagcuguguuaacugguggagugacgcuguucuuccuaucaggaagaggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauacguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaauauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuaguacgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagcuaaccuagauaucauuggccagaggauagagaacauaaaacaugaacauaagucaacauggcauuaugaugaggacaauccauacaaaacaugggccuaccauggaucauaugaggucaagccaucaggaucagccucauccaugguuaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuucuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5762 - RNA, 9879 nt, Artificial Sequence
  derived and/or modified CDS sequence (wt) from DENV-1__FJ410227__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuccuagcacaugccauaggaacauccaucacccagaaagggaucauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauucaagacagcucaugcaaagaagcaggaaguagucguacuaggaucacaagaaggagcaaugcacacugcguugaccggagcaacagaaauccaaacgucuggaacgacaacaauuuuugcaggacauuugaaaugcagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggagggcguguguggaauacgaucaacaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguacuacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagcucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacaaagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugugaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacguuagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgucuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacuacggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcugcugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuacaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccuugguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaauccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgauucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuuggcuucaugaacgaagaucacugguucagcagagagaauucacucagcggaguggaaggagaaggacuccacaaacuuggauacauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacucacauauccaguuggggagauguuccauauuuaggaaaaagggaagaucaaugguguggaucccugauaggcuugacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5763 - RNA, 9879 nt, Artificial Sequence
  derived and/or modified CDS sequence (wt) from DENV-1__FJ859029__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaaaaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaauugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguccaacaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucaugguuaguccacaaacaaugguuucuagaccuaccacugccuuggaccucgggagcuucaacaucacaagagacuuggaacagaaaagaucugcuggugacauuuaagacagcucaugcaaagaagcaggaaguagucgugcuaggaucacaagaaggagcaaugcacacugcguugaccggagcaacagaaauccaaacgucuggaacgacaacaauuuuugcaggacacuugaaauguagacuaaagauggacaagcugacucuaaaagggacgucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaacuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauucuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguaggaguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccaggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguucgugaggccauaaaaaggaagcugcgcacauuaauucuggcucccacaaggguugucgcuuccgaaauggcagaggcgcucaagggaaugccaauaagguaccaaacaacagcagugaagggugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaaaaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugguacuaugcacaucacaaauccucuugaugcggacuacaugggccuugugugaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggccaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugaggaaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgccaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5764 - RNA, 9879 nt, Artificial Sequence
  derived and/or modified CDS sequence (wt) from DENV-1__FJ547065__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccuaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaagaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaaaauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacggccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5765 - RNA, 9879 nt, Artificial Sequence
  derived and/or modified CDS sequence (wt) from DENV-1__FJ410230__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuucaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaucggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuucaucaucgauggcccaaacaccccagagugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacugguacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcgucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaaugucuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaggauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgacucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggauaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucuaaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5766 - RNA, 9879 nt, Artificial Sequence
  derived and/or modified CDS sequence (wt) from DENV-1__FJ410231__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaacaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguucguggacagaggcuggggcaauggcugugggcucuucggaaaaggaagccugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguuuuagugcagauuaaauacgaaggaacagaugcaccaugcaagaucccuuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggcgaaaaagcuuugaaacuaagcugguucaagaaaggaagcagcauagggaaaauguuugaggcaacugccagaggagcacgaaggauggccauauugggagauaccgcaugggacuuugguucuauaggaggaguguucacgucuguuggaaaacuaguacaccagauuuuuggaacugcauauggaguuuuguucagcgguguuuccuggaccaugaagauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucgggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaucuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuaauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucauuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaagaaagagacauuccugaaagaucauggaacucaggcuaugaguggaucacugacuucccagguaaaacaguuugguuuguuccaaguaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggcugacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaagucgccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauacuagaaauagggaaacuuccacaacacuugacgcaaagggcccagaaugcuuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaagggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauuuaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagauguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacaccacacccuuuggacaacagaggguguuuaaagagaaaguugacacacgcacaccaaaagcaaaacggggcacugcacaaaucauggaggugacagccaagugguuauggggcuuucuuuccagaaacaaaaaaccaagaauuuguacaagagaggaguucacaagaaaaguuaggucaaacgcagccauuggggcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagcuggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuuauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugauccugaaggggcacucugguga

SEQ ID NO: 5767 - RNA, 9879 nt, Artificial Sequence
  derived and/or modified CDS sequence (wt) from DENV-1__FJ461323__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggacuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuuggguccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugccgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucacuguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacacagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggacuaaacucaaggagcacgucccuuucgaugacgugcauugcagucggccuaguaacgcuauacuuaggagucaugguucaggcagauucaggauguguaauuaacuggaaagguagagaacucaaauguggaaguggcauuuuugucaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguuuuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaaugccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcggcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucaguagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagacugaucccgaaggggcacucugguga

SEQ ID NO: 5768 - RNA, 9879 nt, Artificial Sequence
  derived and/or modified CDS sequence (wt) from DENV-1__FJ461325__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauaacagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaucacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaauaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaagccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucggccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5769 - RNA, 9879 nt, Artificial Sequence
  derived and/or modified CDS sequence (wt) from DENV-1__FJ410232__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugacagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaaaauaguccaauaugaaaacuugaaauacucaguaauagucaccguccacacuggagaccagcaccaggugggaaaugaaagcacagaacaugggacaacugcaacuauaacaccucaagcuccuacaacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuuuacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuucacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccaggaaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccucuugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugccuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcccaaggggaaacacugggagaaaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuggugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaucuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacguacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauaggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagacuccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcucaucaccaauggaugacaacagaagacaugcugucaguguggaauaggguuuggauagaggaaaacccauggauggaggacaaaacccauauauccagcugggaagauguuccauauuuagggaaaagggaagaccaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugauccugaaggggcacucugguga

SEQ ID NO: 5770 - RNA, 9879 nt, Artificial Sequence
  derived and/or modified CDS sequence (wt) from DENV-1__FJ461327__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaucaagugggaaaugaaagcacagaacaugggacaacugcaacuauaacaccucaagcuccuacgacggaaauacagcugaccgacuacggagcucuuacauuggauuguucaccuagaacaggacuggacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuucuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuucaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaauauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugcccuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuaucggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacaugggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacugggccucugaccacgcuuugggagggaucgccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagacguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5771 - RNA, 9879 nt, Artificial Sequence
  derived and/or modified CDS sequence (wt) from DENV-1__FJ461328__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguggagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucgacaucacaagagacuuggaauagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagaugaaaaaggaguaacccagaaugggagauugauaacagccaaccccauagucacugacaaggaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauccauggaggaccaauaucucagcacaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaguugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacacuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgagauggcagaagcgcucaagggaaugccaauaagguaccaaacaacagcagugaagagugaacacacaggaaaagagauaguugaccucaugugucacgcuacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagaguaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacagacaucuccgaaaugggagcaaauuuccgggccgacagggugauagacccaagacggugucugaaaccgguaauauuaaaagaugguccagagcgugucauuuuggcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccggagagagaaaagagugcagcaauagacggggaauauagacugcggggugaagcaaggaaaacguuuguggagcucaugagaagaggagaccuaccugucuggcuguccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggauggccaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugugaauccaucacacuggccacuggaccucugaccacgcuuugggagggaucuccaggaaaauuuuggaacaccacgauagcgguuuccauggcaaacauuuuuagaggaaguuaucuagcaggagcagguuuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguucguggagaggaaccuugugaaaccagaagggaaagucauagaccuugguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuucauaccaccugagaaaugugauacccuuuugugugauauuggugaguccucuccaaacccaacuauagaggaaggaagaacgcuacgcguucuaaagaugguggaaccauggcucagaggaaaccaauuuugcauaaagauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaagugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggggaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaauuuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 5772 - RNA, 9879 nt, Artificial Sequence
  derived and/or modified CDS sequence (wt) from DENV-1__FJ410234__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacucagaaagggauuaucuucauuuuguuaaugcugguuacaccauccauggccaugcgaugcgugggaauaggcagcagggacuucguggaaggacugucaggagcaacuuggguagaugugguacuggaacauggaaguugugucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagaucaaauacgaaggaacagaugcaccaugcaagauccccuuuucgacccaagaugagaaaggaguaacccagaaugggagauuaauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauagcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaguuccuuggaggagcugggggauggacuugcaaugggcauuaugauuuuaaaauuguugacugacuuucaaucacaucagcugugggcuaccuugcuguccuugacauuuaucaaaacagcauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugauggcaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucucugaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauucugaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacugggccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguuuguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgccaaugcuaucuguucagccguuccaguugauugggucccaacuagccgcaccaccuggucgauccaugcccaucaccaauggaugacaacagaagacaugcugucaguguggaauaggguuuggauagaagaaaacccauggauggaggacaaaacccauauauccagcugggaagauguuccauauuuaggaaaaagggaagaucaaugguguggaucccugauaggcuuaacagcaagggccaccugggccaccaacauacaaguggcuauaaaccaagugagaagacuaauugggaaugagaauuaucuagauuauaugacaucaaugaagagauucaagaacgagagugaucccgaaggggcacucugguga

SEQ ID NO: 5773 - RNA, 9879 nt, Artificial Sequence
  derived and/or modified CDS sequence (wt) from DENV-1__FJ410235__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacaacuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaguuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuacuuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugugaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaauuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaauggaaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucggacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuccucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggcauucucauuaaugaaaucucuaggaggagguaggagaggcacgggagcccaaggggaaacacugggagagaaauggaaaagacagcugaaccaacugggcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucggauguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaccccuacaugccaagugugguggaaacucuggagcaaaugcaaagaaaacauggaggaaugcuggugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagacgagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuagaaaaacauggcgucgaaaggcugaaaagaauggcaaucagcggagaugacugcguagugaaaccaauugaugauagguuugcaacagccuuaacagcucugaaugacaugggaaaaguuagaaaagauauaccacaaugggaaccuucaaaaggauggaaugauuggcaacaagugccuuuuugcucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacucacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauuuaagaacgagagugauccugaaggggcacucugguga

SEQ ID NO: 5774 - RNA, 9879 nt, Artificial Sequence
  derived and/or modified CDS sequence (wt) from DENV-1__FJ410236__SS-prME
ucugugaccaugcuccuuaugcuggugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuggaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuaugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggaguaacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuuccuugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaagucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucaaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5775 - RNA, 9879 nt, Artificial Sequence
  derived and/or modified CDS sequence (wt) from DENV-1__FJ410238__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuauaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggaaacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucaacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaauagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuagguuuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaagacagcaaggcaguucacgcugauaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacacuuccgacaggauggggaugggaacgacguaccuagcucugauggccacuuuuaaaaugagaccaauguuugcuguaggacuauuauuccgcagacuaacauccagagaaguucuucuuuuaacaauuggauugagucuaguggcaucugcggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguucucauguaucaagggaagaggcuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuugacaauaauggaccuacauccaggaucggggaaaacaagaagauaucuuccagccauaguccgugaggccauaaaaaggaggcugcgcacauuaauuuuggcucccacaaggguugucgcuuccgaaauggcagaggcgcucaagggaaugccaauaagguaccaaacaacagcagugaagagugaacacacaggaaaagagauaguugaucucaugugucacgccacuuucacuaugcgccuccugucucccgugagaguucccaauuacaacaugauuaucauggaugaagcgcauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagucuauagacaugcaauggaagaacugccagacaccauagaaacguugaugcuccuagcuuugauagcuguguuaacugguggagugacgcuauucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagcuaaugagaugggacugcuggaaaccacaaagaaagacuuagggaucggccauguggcuguugaaaaucaccaucaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucacuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacgcugggagagaaauggaaaagacagcugaaccaacugaguaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagacaucauuggccagaggauagagaacauaaaacaugaacauaagucaacauggcauuaugaugaggacaacccauauaaaacaugggccuaccauggaucauaugagguuaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugcuacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagguucaagaaugagagugauccugaaggggcacucugguga

SEQ ID NO: 5776 - RNA, 9879 nt, Artificial Sequence
  derived and/or modified CDS sequence (wt) from DENV-1__FJ410239__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacguacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaaguuacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucugcuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauauaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaaguuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuuuugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaaucaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggaucuuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucacuaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcgaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuacugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacaccacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5777 - RNA, 9879 nt, Artificial Sequence
  derived and/or modified CDS sequence (wt) from DENV-1__FJ410240__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauaauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccagccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccgcccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccauaaacaaugguuucuagaccuaccacugccuuggacuucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacaguggucguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccauggugcugucaauuguaucucucuuccccuuaugccuguccacgacuucccaaaaaacaacauggcuuccgguguuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucgcacaacauauuaguggagguccaagaugauggaaccaugaagauaaaggaugaagagagagaugacacgcuaaccauucuccuuaaagcaacccugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguuggguaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggaggcuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuccucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggcauucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagacaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagagaguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugacaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacucacauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5778 - RNA, 9879 nt, Artificial Sequence
  derived and/or modified CDS sequence (wt) from DENV-1__FJ410242__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaauguugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauucaagacagcucaugcaaagaagcaggaaguagucguacuaggaucacaagaaggagcaaugcacacugcguugaccggagcaacagaaauccaaacgucuggaacgacaacaauuuuugcaggacauuugaaaugcagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggagggcguguguggaauacgaucaacaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcucugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagauggguguugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagcucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacaaagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugugaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacguuagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgucuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacuacggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcugcugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuacaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccuugguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaauccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgauucugggaccuugugcacagagagagggagcuucacaaacaggggaaaugugccacguguguuuacaacaugauggggaagagagagaaaaaacuaggagaguucggaaaggcaaaaggaagucgugcaauaugguacauguggcugggagcacgcuuucuagaguucgaagcucuuggcuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacucacauauccaguuggggagauguuccauauuuaggaaaaagggaagaucaaugguguggaucccugauaggcuugacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5779 - RNA, 9879 nt, Artificial Sequence
  derived and/or modified CDS sequence (wt) from DENV-1__FJ410243__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuuaggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcaaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaagcauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaagagggaugucauauguaaugugcacaggcucauucaagcuagagaaagaaguggcugagacccagcauggaaccguucuagugcagauuaaauaugaaggaacagaugcaccaugcaagauaccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaucagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucauggaaaagcuggggaaaggcuaaaaucauaggggcagaugugcagaaugccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcauuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggacccaugaagauaaaggaugaagagagagaugacaugcuaaccauucuccugaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuucugucucccgugagaguucccaauuacaacaugauuaucauggaugaagcacauuucaccgauccauccagcauagcggccagaggguacaucucaacccgaguggguaugggugaagcagcugcuaucuucaugacagcuacucccccaggaucaauggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaauaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaaggagaagcgucucaggugaucuaauauuagaaauagggaaacuuccacaacacuugacgcaaagggcccagaaugccuuggacaaucugguuaucuugcacaacuccgaacaaggaggaagagccuauagacaugcaauggaggaacugccagacaccauagaaacguugaugcuccuagcuuugauagcuguguuaacugguggagugacgcuguucuuccuaucagggaggggccuagggaaaacaucuaucggccuacucugugugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugauacaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcggucuccauggcaaacauuuuuagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacguguccuaaagaugguggaaccauggcucagaggaaaccaauuuugcauaaaaauucugaaucccuacaugccaagugugguggaaacuuuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuagaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagauugauccugaaggggcacucugguga

SEQ ID NO: 5780 - RNA, 9879 nt, Artificial Sequence
  derived and/or modified CDS sequence (wt) from DENV-1__FJ410244__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccauugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagaugaacaagcugacucuaaaagggaugucauauguaaugugcacaggcucauucaagcuagagaaagaaguggcugagacccagcauggaaccguuuuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaggcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaaccuauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaauuugcgugauuccuacacccaagugugugaccaccggcuaaugucagcugccaucaaggacagcaaggcaguucacgcugacaugggguacuggauagaaagugaaaagaacgagaccuggaagcuggcaagagccucuuuuauagaaguuaaaacauguaucuggccaaagucccauacucuauggagcaauggaguucuggaaagugaaaugauaauuccaaagaucuauggaggaccaauaucucagcacaacuacagaccaggauauuucacacaaacggcagggccguggcaccuaggcaaguuggaacuggacuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacgauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggggaagcagcugcgaucuucaugacagcuacucccccaggaucaguggaggccuuuccacagagcaacgcaauuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggccuugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggaaccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugaggugcccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguuuagcagagagaauucacucagcggaguggaaggagaaggacuccacaaacuuggauauauacucagggacauaucaaagauuccagggggaaacauguaugcagaugacacagccggaugggauacgaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaauacuuucaccaacauggaagcucagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauguaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucaauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5781 - RNA, 9879 nt, Artificial Sequence
  derived and/or modified CDS sequence (wt) from DENV-1__FJ410245__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguugugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacaguugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugacuggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucaaaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacauaggagaagaagugcaggugauugcuguugaaccagggaaaaaccccaaaaauguacaaacagcgccgggcaccuuuaagaccccugaaggcgaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaagaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugcugcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcaaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugagagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucauaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5782 - RNA, 9879 nt, Artificial Sequence
  derived and/or modified CDS sequence (wt) from DENV-1__FJ410246__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggauaagcugacucuaaaggggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagacaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguuuacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagcuaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaccgaagaggugaugagauccagauggaguagaaaaaugcugaugacuggaacacuggcuguguucuuccuucucauaaugggacaacugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaagugcuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacaaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccguuagcugggccacuaauagcuggaggcaugcuaauagcauguuauguuauauccggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaggaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccaugaggccauaaaaaggaagcugcgcacauuaauucuggcucccacaaggguugucgcuuccgaaauggcagaggcgcucaagggaaugccaauaagguaccaaacgacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagaguaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacgucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaauuugguuauguugcacaacuccgaacaaggaggaagagccuauagacacgcaauggaggaauugccagacaccauagaaacguugaugcuccuagcuuugauagcuguguuaacugguggagugacgcuguucuuccuaucaggaagaggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcugucgaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcagcgguauugaugcuaguggcucauuacgccauaauuggaccuggacugcaagcaaaagcuacuagagaagcucaaaaaaggacagcagccggcauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaauauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugagaugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuaguacgaaauccacuuucaagaaauucuacucaugaaauguauuggguuucauguggaacaggaaacauugugucagcaguaaauaugacauccagaauguugcuaaaucgauucacaauggcucacaggaaaccaacguacgaaagagacguggaccuaggcgccggaacaagacauguggcaguggaaccugagguagcuaaccuagauaucauuggccagaggauagagaacauaaaacaugaacauaagucaacauggcauuaugaugaggacaauccauacaaaacaugggccuaccauggaucauaugaggucaagccaucaggaucagccucauccaugguuaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaagacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaagaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5783 - RNA, 9879 nt, Artificial Sequence
  derived and/or modified CDS sequence (wt) from DENV-1__FJ410247__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaccaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcccaugcaaagaagcaagaaguggucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggccuaguaacacuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaauuauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagcuucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucaauuguaucucucuuccccuuaugccuguccacgaccucccaaaaaacaacauggcuuccggugcuauugggaucccuuggaugcaaaccacuaaccauguuucucauagcagaaaacagaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugauuucauauggaggagguuggaggcuucaaggauccuggaacacaggagaagaagugcaggugauugcuguugaaccagggaaaaaccccaaaaauguacaaacaacgccgggcacuuuuaagaccccugaaggugaaguuggagccauugcccuagauuuuaaacccggcacaucuggaucucccaucgugaacagagaaggaaaaauagugggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaagcauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaggcaaggaaaacguuuguggagcucaugagaagaggagaucuaccugucuggcuaucuuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuggaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguuuuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuggggauuggccauguggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugagaugguuuguggagcggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacaaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugauugcguggugaaaccaauugaugauagguuugcaacagccuuaacagcucugaaugacaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacauacaaguggccauaaaccaagugagaagacuaauugggaaugagaauuaccuagauuacaugacaucaaugaagagauucaagaacgagagugaucccgaaggggcacucugguga

SEQ ID NO: 5784 - RNA, 9879 nt, Artificial Sequence
  derived and/or modified CDS sequence (wt) from DENV-1__FJ410248__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagagcuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuagccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuaucuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacuuuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucagugauagucaccguccacacuggagaccagcaccaggugggaaaugaaagcacagaacacgggacaacugcaacuauaacaccucaagcuccuucgacggaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagagacuuggaacagacaagauuugcuugugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuuguggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacaugcauugcaguuggccuaguaacauuauaccuaggagucaugguucaggcggauucaggauguguaauuaauuggaaaggcagagaacucaaauguggaaguggcauuuuugucaccaaugaaguucacacuuggacagagcaauacaaauuucaagcugacuccccaaagagacuaucagcugccaucgggaaggcaugggaggaggguguguguggaauacgaucagcaacucgucucgagaacaucauguggaagcaaauaucaaaugaacugaaccacaucuuacuugaaaaugacaugaaauucacaguggucguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuagcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuuaauuugugugaggguaccacaguuguuguggaugaacacuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaaugcuagcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguauuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucucauagcagaaaacaaaaucuggggaaggaaaaguuggccccucaaugaaggaaucauggcuguuggaauagucagcauucuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuccaaggauccuggaacacgggagaagaagugcaggugauugccguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccccuaccagagauugaaaacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaguugagcagaaaaacuuuugauacagaguaccaaaaaacaaaaaauaacgacugggacuacgucgucacaacagacaucucugaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcucagaaugccuuggacaaucugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggcuuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauauugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcaaaccaggcggccauauuaaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccagcugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaacuuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaauauugugucagcaguaaacaugacauccagaauguugcuaaaucgauucacaauggcucacaggaaaccaacguaugaaaaagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucucucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggggaguuuggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucgaucuuuaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagagugucacaaggugcuggauggagccugagagaaacugcaugccuaggcaagucauaugcacaaauguggcaguugauguacuuccacaggagagaccugagacuagccgcuaaugcuaucuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacagguggccauaaaccaagugagaagacugauugggaaugagaauuaucuagauuacaugacaucaaugaagagauucaagaacgagagugauccugaaggggcacucugguga

SEQ ID NO: 5785 - RNA, 9879 nt, Artificial Sequence
  derived and/or modified CDS sequence (wt) from DENV-1__FJ410249__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggcacauguucccaaacuggcgagcgccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaguaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguuuuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggagcugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggacucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacccgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaaccuauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuuuauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggacuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuucuuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaacuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucucggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagccggaggcaugcuaauagcauguuauguuauaucuggaagcucagccgaccuaucacuagagaaagcagcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgagauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuucaugacagcuaccccuccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuugagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaauacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcugccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcugucgaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaaucccaauggcgaccuauggauggaaccuaguaaaacugcacuccgggaaagacguauucuuuauaccacccgagaaaugugacacccuuuugugugacauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaaugguguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagggacauaucaaagauuccagggggaaacauguaugcagaugacacagccggaugggacacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaauacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauguaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgccaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5786 - RNA, 9879 nt, Artificial Sequence
  derived and/or modified CDS sequence (wt) from DENV-1__FJ410251__SS-prME
ucugugaccaugcuucucaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggaucauuuucauuuuguuaaugcugguaacaccauccauggccaugcgaugcguaggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucgugcuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgcccuuuggugagaguuacaucguaauaggagcagguggaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugcuaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguuuuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacugacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaucugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaagucggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuagacaaccuggucauguugcacaacuccgaacaaggaggaagagccuauagacaugcaauggaagaauugccagacaccauagaaacgcugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacaggcaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagacuuggacccuguggucuaugaugcaaaauuugagaaacaacuaggccaaauaauguuguuaauauuaugcaccucacagauccucuugaugaggaccacaugggccuugugcgaauccaucacacuggccacuggaccucugaccacgcuuugggagggaucuccagggaaauuuuggaacacuacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcuguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5787 - RNA, 9879 nt, Artificial Sequence
  derived and/or modified CDS sequence (wt) from DENV-1__FJ410252__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccuacguaaacugugcauugaagcuaaaauaucaaacaccaccacugacucaagauguccaacacaaggagaagccacacugguggaagaacaagacgcgaacuuugugugucgacgaacgcuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacaccugaaauguagauuaaagauggauaagcugacucuaaaggggaugucauauguaaugugcacaggcucauucaagcuagagaaagaaguggcugagacccagcauggaaccguucuagugcagauuaaauaugaaggaacagaugcaccaugcaagaucccuuuuuugacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucgggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugacuaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguacuacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggccguguucuuccuucucauaaugggacaacugacauggaaugaucugaucagauuaugcaucaugguuggagccaacgcuuccgacaggauggggaugggaacgacguaccuagcucugauggccacuuuuaaaaugagaccgauguuugcuguaggacuauuauuccgcagacuaacauccagagaaguacuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacaaccucccaaaaaacaacauggcuuccggugcuauugggaucucuuggaugcaaaccgcuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaggaccugaucucauauggaggagguuggagacuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuucaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggcuagaggguacaucucaacccgagugggcaugggugaagcagcugcgaucuucaugacagcuacucccccaggaucaguggaggcuuuuccacagaguaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaacuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggcgaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaauugccagacaccauagaaacguugaugcuccuagcuuugauagcuguguuaacugguggagugacgcuguucuuucuaucaggaagaggccuagggaaaacaucuaucggccuacucugcgugauggcuucaagcgugcugcuauggauggccaguguggagccccauuggauagcggccuccaucauauuggaguucuuccugauggugcugcuuauuccagagccagacagacaacgcacuccgcaggacaaccagcuggcauacguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggaggcaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguguucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacaugggggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagcuaaccuagauaucauuggccagaggauagagaacauaaaacaugaacauaagucaacauggcauuaugaugaggacaauccauacaaaacaugggccuaccauggaucauaugaggucaagccaucaggaucagccucauccaugguuaauggcguggugaaacugcucaccaaaccaugggaugucauccccauggucacacaaauagccaugacugacacuacacccuuuggacaacagaggguguucaaagagaaaguugacacacgcacaccaaaagcaaagcgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucucccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagcuguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5788 - RNA, 9879 nt, Artificial Sequence
  derived and/or modified CDS sequence (wt) from DENV-1__FJ461331__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggacuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccacuaccgacucaagauguccaacacaaggagaagccacacugguggaagaacaagacgcgaacuuuguaugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguuuugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggagugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuucgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaauauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccaguaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggccaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaacaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagcgcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagauagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuacucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacacuuugggagggaucuccaggaaaauuuuggaacaccacgauagcgguuuccauggcaaacauuuucagaggaaguuauuuagcaggagcaggucuggccuucucauuaaugaaaucccuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacacgcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcagcaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacagaagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5789 - RNA, 9879 nt, Artificial Sequence
  derived and/or modified CDS sequence (wt) from DENV-1__FJ410256__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaaaaguggagacuugggcccugagacacccaggauucacggugauagcccuuuuccuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacacgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccgcaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauucaagacagcucaugcaaagaagcaggaaguagucguacuaggaucacaagaaggagcaaugcacacugcguugaccggagcaacagaaauccaaacgucuggaacgacaacaauuuuugcaggacauuugaaaugcagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggagggcguguguggaauacgaucaacaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggauuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacaucuagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagcucacuccucaaaaaugaugugccgcuagcugggccacuaauagcuggaggcaugcuaauagcauguuauguuauaucuggaagcucagccgaccuaucacuagagaaagcagcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacaaagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugugaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacguuagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgucuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacuacggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugguggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcugcugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuacucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuacaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccuugguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaauccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgauucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuuggcuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgccgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucugcucagccguuccaguugauugggucccaaccagccgcaccaccuggucgauccaugcccaucaccaauggaugacaacagaagacaugcugucaguguggaauaggguuuggauagaggaaaacccauggauggaggacaaaacucacauauccaguuggggagauguuccauauuuaggaaaaagggaagaucaaugguguggaucccugauaggcuugacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5790 - RNA, 9879 nt, Artificial Sequence
  derived and/or modified CDS sequence (wt) from DENV-1__FJ410257__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccucgaaucacugaggcggaaccagaugacguugauugcuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuuuuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaaaauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguucuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauccccuuuacgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggaugcguaauuaacuggaaagguagagaacucaaauguggaaguggcauuuuugucaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccacuuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccauuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaggagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguauauauagaauuaugcagagaggacuguugggcaggucccaaguagggguaggaguuuuucaagaaaacguguuccacacaauguggcaugucaccaggggagcuguacucauguaucaagggaagagacuggaaccgagcugggcuagugucaaaaaagaccugaucucauauggaggaggauggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucucaggcaaaacaguuugguuuguuccaagcauuaaaucaggaaaugacauugccaacugccuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaacuacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagacagaaagaaacuacgaccccgcuggcuggaugccagaacauacucagacccacuggcccugcgcgaguuaaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcucugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagaaccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcccaaggggaaacacugggagaaaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaccaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugauccugaaggggcacucugguga

SEQ ID NO: 5791 - RNA, 9879 nt, Artificial Sequence
  derived and/or modified CDS sequence (wt) from DENV-1__FJ461332__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccacuaccgacucaagauguccaacacaaggagaagccacacugguggaagaacaagacgcgaacuuuguaugccgacgaacguuuguggacagaggcuggggcaauggcugugggcucuucggaaaaggaagucuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaccugaucagauuaugcaucaugguuggagccaacgccuucgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaauauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccaguaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggccaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaaggaauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuucugauggugcugcuuauuccagagccagauagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuacucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugauguaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucccuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucggcuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacacgcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcagcaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacagaagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5792 - RNA, 9879 nt, Artificial Sequence
  derived and/or modified CDS sequence (wt) from DENV-1__FJ461333__SS-prME
ucugugaccaugcuccuuaugcugaugccuacagccuuggcguuccauuugaccacacgagggggagagccgcacaugguagucagcaagcaggaaagaggaaaaucacucuuguucaagaccucagcaggugucaacauguguacccuuauagcgauggaucugggagaguuaugugaggacacaaugacuuacaaaugcccucgaaucacugaagcugaaccagaugacguugacuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacucagaaagggauuauuuucauuuuguuaaugcugguaacaccauccauggccaugcgaugcgugggaauaggcagcagggacuucguggaaggacugucaggagcaaccuggguagaugugguacuggaacauggaaguugcgucaccaccauggcaaaagacaaaccaacauuggacauugaacucuugaagacggaagucacaaacccugccauccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguucacaccggagaccagcaucaggugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagaccuggaacagacaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagauugauaacagcuaacccuauaguuacugacaaagaaaaaccagucaacauugaggcagaaccgccuuuuggugagaguuacaucguaauaggagcaggugaaaaagcuuugaaacuaagcugguuuaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggauuagggguucugcugacauggcuaggauuaaacucaaggagcacgucccuuucgaugacgugcauugcaguuggccuaguaacacuauacuuaggagucaugguucaggcggauucaggauguguaauuaauuggaaagguagagaacucaaauguggaaguggcauuuuugucaccaaugaaguccacaccuggacagagcaauacaaauuucaagcugacuccccaaagagacuaucagcagccaucgggaaggcaugggaggaggguguguguggaauucgaucagcaacucgucucgagaacgucauguggaagcaaauaucaaaugaacugaaucacaucuuacuugaaaaugauaugaaauucacagugguuguaggagauguugcugggaucuuggcucaaggaaagaaaaugauuaggccacaacccauggaacacaaauacucguggaaaagcuggggaaaggcuaaaaucauaggggcagauguacagaacaccaccuuuaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguuccuccuucucauaaugggacaauugacauggaaugaucugaucagauuaugcaucaugguuggagccaacgcuuccgacaggauggggaugggaacgacguaccuagcucugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuaugcauggaagacaauggcuaugguacugucgauuguaucucucuuccccuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuucucaaaaaugaugugccgcuagcugggccacuaauagcuggaggcaugcuaauagcauguuauguuauaucuggaagcucagccgaccuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccacuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccaccuucaccaugcgccuccugucucccgugagaguucccaauuacaacaugauuaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguaauccaagaugaggaaagagacauuccugagagaucauggaacucaggcuaugaguggaucacugacuucccagguaaaacaguuugguuuguuccaaguauuaaaucaggaaaugacauagccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccggagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagagggagaaagaaagaaacuacgaccccgcuggcuggaugccagaacauacucagacccacuagcccugcgcgaguuuaaagaguuugcagcagggagaagaagcgucucaggugaucuaauauuagaaauagggaaacuuccacaacacuugacgcaaagggcccagaaugccuuggacaaccugguuauguugcacaacuccgaacaaggaggaagagccuacagacaugcaauggaagaacugccagacaccauagaaacguugaugcuccuagcuuugauagcuguguuaacugguggagugacacuguucuucuuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccaugcggcuguuggaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugaugggauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaagagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaagggggaccuggacaugaggaaccaaucccaauggcgaccuauggauggaaccuaguaaagcugcacucugggaaagacguauucuuuauaccaccugagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguacuggguuucauguggaacaggaaacauugugucagcaguaaacaugacaucuagaauguugcuaaaucgauucacaauggcucacaggaaaccaacauaugaaagagauguggaccuaggcgccggaacaagacauguggcaguggaaccagagguagcuaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaagccaugggaugucauccccaugguuacacaaauagccaugacugacacuacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugccacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucaguagagagaauucacucagcggaguggaaggagaaggacuccacaaacuuggauauauacucagagacauaucaaagauuccagggggaaacauguaugcagaugacacagccggaugggacacaaggauaacugaggaugaccuucagaaugaggccagaauuacugacaucauggaacccgaacaugcccuacuggcuaagucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguggugaaaccaauugaugauagguuugcaacagccuuaacagcucugaaugauaugggaaaagugagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauuggaucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuagggaaaagggaagaucaaugguguggaucccugauaggcuuaacagcaagggccaccugggccaccaacguacaaguggccauaaaccaagugagaagacuaauugggaaugagaauuaccuagauuacaugacaucaaugaagagauucaagaacgagagugaucccgaaggggcacucugguga

SEQ ID NO: 5793 - RNA, 9879 nt, Artificial Sequence
  derived and/or modified CDS sequence (wt) from DENV-1__FJ410262__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaagggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggacuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaacuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugguuugugugaggguaccacaguuguuguggaugaacauuguggaaaucgaggaccaucucuuaggaccacaacaguuacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggacugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcauuaugcauggaagacaauggccaugguacugucaauuguaucucucuuccccuuaugccuguccacgaccucccaaaaaacaacauggcuuccggugcuauugggaucucuuggaugcaaaccgcuaaccauguuucuuauagcagaaaacaaaaucuggggaaggaaaaguuggccucucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccucuugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagauauuccugagagaucauggaacucaggcuaugaguggaucacugacuucccgggcaaaacaguuugguuuguuccaaguaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaccaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaaagaggcacagcacagaucauggaggugacagccaagugguuaugggguuuucuuucuagaaacaagaaaccaagaauuugcacaagagaggaguucacaagaaaaguuaggucuaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaagugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauucaugcccaucaccaauggaugacaacagaagacaugcugucaguguggaauaggguuuggauagaggagaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5794 - RNA, 9879 nt, Artificial Sequence
  derived and/or modified CDS sequence (wt) from DENV-1__FJ410263__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacauaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaauaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaagccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucggccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5795 - RNA, 9879 nt, Artificial Sequence
  derived and/or modified CDS sequence (wt) from DENV-1__FJ410264__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccguugcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaggggaucauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaaaaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagacugauaacagcuaauccuauagucacugacaaagaaaaaccagucaacauugaggcagaaccgcccuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaauuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccaccuuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguuuuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauucuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaucugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuagacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuucuuaauggugcugcuuauuccagagccagacaggcaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguagauggaauuguugcaauagacuuggacccuguggucuaugaugcaaaauuugagaaacaacuaggccaaauaauguuguuaauauuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucacuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagaggugguuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacucuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcuguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggaaaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaccuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5796 - RNA, 9879 nt, Artificial Sequence
  derived and/or modified CDS sequence (wt) from DENV-1__FJ410265__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcuacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagaccuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacaugcaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcacaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauugucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucagguuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacacccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacauugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagagaaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagagcucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5797 - RNA, 9879 nt, Artificial Sequence
  derived and/or modified CDS sequence (wt) from DENV-1__FJ461336__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuagaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcaacagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccacugacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacagugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaagcugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggagugcucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacccuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguugccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaacgauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugacaauauaaacacaccagaagggauuaucccagcucucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuauuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccagguaaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcaaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacaccacacccuuuggacaacagaggguguuuaaagagaaaguugacacacgcacaccaaaagcaaaacggggcacagcacaaaucauggaggugacagccaagugguuaugggguuuucucucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacagauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5798 - RNA, 9879 nt, Artificial Sequence
  derived and/or modified CDS sequence (wt) from DENV-1__FJ410266__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacguaggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagaugugguacuggaacauggaagcugcgucaccaccauggcgaaagacaaaccaacauuggacauugaacuccugaagacggaagucacaaacccugccguccugcgcaaacugugcaucgaagcuaaaauaucaaacaccaccaccgacucaagauguccaacacaaggagaagccacacucauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauacucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccaacauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauacggaguuuuguucagcgguguuuccuggaccaugaaaauaggaauagggguucuacugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauauaaauuucaagcugacuccccaaagagauuaucagcagccaucgggaaggcaugggaggaggguguguguggaauucgaucagccacucgucucgagaauaucauguggaagcaaauaucaaaugaacugaaccacaucuuacuugaaaaugacaugaaguucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaacuacagaccaggauauuucacacaaacggcagggccguggcaucuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggagcaaaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauagccacuuuuaaaaugagaccaauguuugcugucgggcuacuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuuuacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggacgaagagagagaugacacgcuaaccauucuccuuaaagcaacucugcuagcaguuucagggguguacccacuaucaauaccagcgacccuuuuuguguggcacuuuuggcagaaaaagaaacagagaucuggagugcuaugggauacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacuuauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuucaaacccggcacaucuggaucucccaucgugaacagagaaggaaaaauaguaggucuuuauggaaauggaguggugacaacaagugggaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauccuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccuaauggugcugcuuauuccagagccagacagacaacgcacuccgcaagacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaucaggcagcuauauugaugggacuugacaaaggauggccaauaucgaagauggacauaggaguuccacuucucgccuuagggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggaggggucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaagucagaauucaacacuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacguguccuaaaaaugguggaaccauggcucagagggaaccaauuuugcauaaaaauucuaaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacauaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacaccacacccuuuggacaacagaggguguucaaagagaaaguugacacgcgcacaccaaaagcaaaacgaggcacagcacaaaucauggaggugacagccaaaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccggcgaauuggagaccccaaauuuagccgagaggguucucgacuggcuggaaaaauauggugucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacugauugggaaugagaauuaucuagauuacaugacaucaaugaagagauucaagaacgagggcgaucccgaaggggcacucugguga

SEQ ID NO: 5799 - RNA, 9879 nt, Artificial Sequence
  derived and/or modified CDS sequence (wt) from DENV-1__FJ410269__SS-prME
ucugugaccaugcugcucaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguagauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuaacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagucacucgucucgagaauaucauguggaagcaaauaucaaaugaacugaaccacauccuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacacaaccuucaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccgguuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggagagugaaaugguaauuccaaaaaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggagauaccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaacgaugugccgcuagcugggccacuaauagcuggaggcaugcuaauagcauguuauguuauaucuggaagcucagcugacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaggaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagguccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacucgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacugcuggaaaccacaaagaaagacuuagggauuggccauguggcuguugaaaaucaccaccaugccacaaugcuggauguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuuuagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggacccggacaugaggaaccaaucccaauggcgaccuauggauggaaccuaguaaaacugcacuccgggaaagacguauucuuuacaccaccugagaaaugugacacacuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaccgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaauuugcacaagagaggaguucacaaggaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuaccgacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaaugagggugaucccgaaggggcacucugguga

SEQ ID NO: 5800 - RNA, 9879 nt, Artificial Sequence
  derived and/or modified CDS sequence (wt) from DENV-1__FJ410273__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagagcuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuagccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuaucuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacuuuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucagugauagucaccguccacacuggagaccagcaccaggugggaaaugaaagcacagaacacgggacaacugcaacuauaacaccucaagcuccuucgacggaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagagacuuggaacagacaagauuugcuugugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuuguggcaacugccagaggagcacgaaggauggccauacugggagacaccgcaugggacuuugguucuauaggaggaguguucacgucuguuggaaaauuaguacaccagauuuuuggaacugcauauggaguuuuguuuagcgguguuuccuggaccaugaaaauaggaauaggaguucugcuaacauggcuaggauuaaacucaaggagcacgucccuuucgaugacaugcauugcaguuggccuaguaacauuauaccuaggagucaugguucaggcggauucaggauguguaauuaauuggaaaggcagagaacucaaauguggaaguggcauuuuugucaccaaugaaguucacacuuggacagagcaauacaaauuucaagcugacuccccaaagagacuaucagcugccaucgggaaggcaugggaggaggguguguguggaauacgaucagcaacucgucucgagaacaucauguggaagcaaauaucaaaugaacugaaccacaucuuacuugaaaaugacaugaaauucacaguggucguaggagauguugcuggaaucuugacucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuagcaagagccucuuucauagaaguuaaaacauguaucuggccaaagucccacacucuauggagcaauggaguucuggaaagugaaaugauaauuccaaagaucuauggaggaccaauaucucagcacaacuacagaccaggguauuucacacaaacggcagggccguggcaccuaggcaaguuggaacuggauuuuaauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaaugcuagcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguauuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucucauagcagaaaacaaaaucuggggaaggaaaaguuggccccucaaugaaggaaucauggcuguuggaauagucagcauucuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuccaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccccuaccagagauugaaaacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaguugagcagaaaaacuuuugauacagaguaccaaaaaacaaaaaauaacgacugggacuacgucgucacaacagacaucucugaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcucagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcaaaccaggcggcuauauuaaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccagcugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaacuuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaauauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucucucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggggaguuuggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucgaucuuuaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggaguccgagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacagguggccauaaaccaagugagaagacugauugggaaugagaauuaucuagauuacaugacaucaaugaagagauucaagaacgagagugauccugaaggggcacucugguga

SEQ ID NO: 5801 - RNA, 9879 nt, Artificial Sequence
  derived and/or modified CDS sequence (wt) from DENV-1__FJ410276__SS-prME
ucugugaccauguuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugacugacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuuugacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugacuugugugaggguaccacaguuguuguggaugaacauuguggaaaucgaggaccaucucuuaggaccacaacagucacaggaaagauaauucaugaaugguguugcagaucuugcacguuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagcugaccuaucauuagagaaagcggcugaggucuccugggaagaagaagcagaacacucuggugccucacacaauauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuacagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccagagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuaugguuacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguuuacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucuaugaagagauucaagaacgagagugaucccgaaggggcacucugguga

SEQ ID NO: 5802 - RNA, 9879 nt, Artificial Sequence
  derived and/or modified CDS sequence (wt) from DENV-1__FJ410278__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaucuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaauaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccauugggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaagcuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagagaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucacugauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugcugcaaugcuggacguagacuuacauccagcuucagccuggacccucuaugcaguggccacaacaauuaucacucccaugaugaggcacacaaucgaaaacacaacggcaaacauuucccugacagccauugcaaaucaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucggcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagacuacaugacaucaaugaagagauucaagaacgagagugaucccgaaggggcacucugguga

SEQ ID NO: 5803 - RNA, 9879 nt, Artificial Sequence
  derived and/or modified CDS sequence (wt) from DENV-1__FJ410279__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcagguguuaacaugugcacccuuauagcgauggauuugggagaguuuugugaggauacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggauaagcugacucuaaaggggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaacugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacaaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucgcacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuuuugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaggaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuauaacaugauuaucauggaugaagcacauuucacugauccauccagcauagcggccagaggguacaucucaacccgagugggcaugggugaagcagcugcgaucuucaugacagcuacucccccaggaucaguggaggccuuuccacagaguaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcccacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaguauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucuggucauguugcacaacuccgaacaaggaggaagagccuauagacaugcaauggaggaauugccagacaccauagaaacguugaugcuccuagcuuugauagcuguguuaacugguggagugacgcuguucuuccuaucaggaagaggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacacuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauacacgaaaggaggaccuggacaugaggagccaauuccaauggcgaccuauggauggaaccuaguaaaacugcacuccgggaaagauguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaauccuuacaugccaagcgugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagcuaaccuagauaucauuggccagaggauagagaacauaaaacaugaacauaagucaacauggcauuaugaugaggacaauccauacaaaacaugggccuaccauggaucauaugaggucaagccaucaggaucagccucauccaugguuaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugaugggaaagagagagaaaaaacuaggagaguucggaaaggcaaaaggaagucgugcaauaugguacauguggcugggagcacgcuuucuagaguucgaagcccuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccaacugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuucuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugccaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuaauugggaaugagaauuaucuagauuauaugacaucaaugaagagauucaagaacgagagugauccugaaggggcacucugguga

SEQ ID NO: 5804 - RNA, 9879 nt, Artificial Sequence
  derived and/or modified CDS sequence (wt) from DENV-1__FJ410283__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaaguuacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaauuggcugagacccagcauggaaccguucuagugcagauuaaauacgaaggaacagaugcaccaugcaagaucccuuuuucgacccaagaugaaaaaggagugacccagaaugggagauugauaacagcuaaccccauaguuacugacaaagaaaaaccaguuaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacacugcaugggacuuugguucuauaggaggaguguucacgucugcuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauauaaauuucaagcugacuccccaaagagacuaucagcagccaucgggaaggcaugggaggaggguguguguggaauucgaucagcgacucgucucgagaacaucauguggaagcaaauaucaaaugaacugaaucacauccuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguggggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaacuuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucacuaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaaugcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucuccgaaaugggagcgaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaagcuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaacuuagccgagagaguucucgacuggcugggaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuagggaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5805 - RNA, 9879 nt, Artificial Sequence
  derived and/or modified CDS sequence (wt) from DENV-1__FJ410284__SS-prME
ucugugaccaugcugcuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauugcugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuggaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauuuaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuccaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacacaaccuucaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggagagugaaaugguaauuccaaaaaucuauggaggaccaauaucucagcacaacuacagaccaggauauuucacacaaacggcagggccguggcaccuagguaaguuggaacuggauuuugauuugugugaggguacuacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaacuauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagcugacuuaucacuagagaaagcggcugaggucuccugggaagaagaagcagaacacucuggugccucgcacaauauauuaguggagguccaagaugauggaacuaugaagauaaaggaugaagagaaagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagguccccuaccagagauugaagaugagguguuuaggaaaagaaacuuaacaauaauggaccuacauccaggaucggggaaaacaagaagauaucucccagccauaguccgugaggccacaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacucgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggcuagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauugugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacacuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacagaaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaaucuguacaagagaggaguucacaaggaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagauauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5806 - RNA, 9879 nt, Artificial Sequence
  derived and/or modified CDS sequence (wt) from DENV-1__FJ410285__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguucguggacagaggcuggggcaauggcugugggcucuucggaaaaggaagccuaauaacgugugcuaaguucaagugugugacaaaacuggaaggaaagauaguucaacaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuucauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacgauuuuugcaggacacuugaagugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuucuuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucggaaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggccaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauuggcugacuuucaaucacaucaacugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacauccggaucucccauugugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaggcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccaggcaaaacaguaugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagcgccgcccagaggagaggaagaauuggaaggaaccacaauaaggaaggugaucaguacaucuacaugggacagccuuuaaacaacgaugaagaucacgcucacuggacagaagcaaaaaugcuucuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggugaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuucuagcucugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccggagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguagaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacagauggagucugagggaaucuuuucacccagcgaauuagagaccccaaauuuagcugagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggauccuugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5807 - RNA, 9879 nt, Artificial Sequence
  derived and/or modified CDS sequence (wt) from DENV-1__FJ410286__SS-prME
ucugugaccaugcuccuuaugcugaugccuacagcccuggcguuccauuugacuacacgagggggagagccgcacaugauagucagcaagcaggaaagaggaaagucacuuuuguuuaagaccucagcaggugucaauaugugcacccuuauagcgauggauuugggagaguuaugugaggacacaaugacuuacaaaugcccucgaaucacugaggcggaaccggaugacguugauuguuggugcaaugccacagacacaugggugaccuauggaacauguucccaaacuggcgagcaccgacgagaaaaacguuccgucgcacuggccccacacgugggacuugguuuggaaacaagaacugaaacguggauguccucugaaggcgcuuggaaacagauacaaaggguagagacuugggcccugagacacccaggauucacggugauagcccuuuuucuagcacaugccauaggaacaucuaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugucgacgaacguuuguggacagaggcuggggcaauggcugugggcucuucggaaaaggaagccuacuaacgugugcuaaguucaagugugugacaaaacuggaaggaaagauaguucaauaugaaaacuugaaauauucaguaauagucaccguccacacuggagaccagcaucaggugggaaaugaaagcacagaacaugggacaacugcaacuauaacaccucaagcucccacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagacuuaccacugccuuggacuucgggagcuucgacaucacaagagacuuggaauagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacucagcauggaaccguucuagugcagauuaaauaugaaggaacagaugcaccaugcaagauuccuuuuucgacccaagauggaaaaggaguaacccagaaugggagauugauaacagccaaccccauagucacugacaaggaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccucucgaugacgugcauugcaguuggccuaguaacacuauaccuaggagucaugguucaggcggauucaggaugcguaauuaauuggaaagguagagaacucaaauguggaagugguauuuuugucaccaaugaaguucacacuuggacagagcaauacaaauuucaagcugacuccccaaagagacuaucagcagccauugggaaggcaugggaggaggguguguguggaauucgaucagcaacucgucucgagaacaucauguggaagcaaauaucaaaugaacugaaccacaucuuacuugaaaaugacaugaaauucacagugguuguaggagauguugcugggaucuugguucaaggaaaaaaaaugauuaggccacaacccauggaauacaaauacucguggaaaagcuggggaaaggcuaaaaucauaggggcagauguacagaacuccaccuucaucauugacggcccaaacaccccagaaugcccugaugaccaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugacaugggcuacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagauccauggaggaccaauaucucagcacaacuacagaccaggauauuucacacaaacggcagggccguggcaccuaggcaaguuggaacuggauuuugauuugugugaggguaccacagucguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaguugacauggaaugaucugaucagauuaugcaucaugguuggagccaacgcuuccgacagaauggggaugggaacgacguaccuagcucugauggccacuuuuaaaaugagaccaauguuugcuguagggcuauuauuccgcagacuaacauccagagaaguucuucuucuaacaauuggauugagucuaguggcaucuguggaguuaccaaauuccuuggaggagcugggggauggacuugcaaugggcaucaugauuuuaaaauuauugacugacuuucaaucauaucaguugugggcuaccuugcuguccuugacauuuaucaaaacaacguuuucccugcacuaugcauggaagacaauggcuaugguacugucaauuguaucucucuuccccuuaugccuguccacgaccucccagaaaacaacauggcuuccggugcuauugggaucucuuggaugcaaaccacuaaccauguuucuaauagcagaaaacaaaauuuggggaaggaaaaguuggccccucaaugaagggaucauggcuguuggaauagucagcauccuauuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucaggugccucacacaacauauuaguggagguccaagaugauggaaccaugaagauaaaggaugaagagagagaugacacacuaaccauucuccuuaaagcaacucugcuagcaguuucagggguguacccauuaucaauaccagcgacccuuuuuguguggcacuuuuggcagaaaaagaaacagagaucuggaguguugugggacacaccuagcccuccagaaguggaaagagcaguucuugaugaugguaucuauagaauuaugcagagaggacuguugggcaggucccaaguaggggugggaguuuuucaagaaaacguguuccacacaauguggcaugucaccaggggagcuguacucauguaucaagggaagagacuggaaccgagcugggccagugucaaaaaagaccugaucucauauggaggagguuggagguuucaaggauccuggaacacgggagaagaagugcaggugauugcuguugaaccagggaaaaaccccaaaaauguacaaacagcgccgggcaccuuuaagaccccugaaggugaaguuggagccauugcccuagauuucaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgaaguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgagauggcagaagcgcucaagggaaugccaauaagguaccaaacaacagcagugaagagugaacacacaggaaaagagauaguugaccucaugugucacgcuacuuucaccaugcgccuccugucucccgugagaguucccaauuacaauaugauuaucauggaugaagcacauuucaccgauccauccagcauagcggccagaggguacaucucaacccgagugggcaugggugaagcagcugcaaucuucaugacagccacucccccaggaucaauggaggccuuuccacagaguaacgcaguuauccaagaugaggaaagagacauuccugagagaucauggaacucaggcuaugaguggaucacugacuucccagguaaaacagucugguuuguuccaagcauuaaagcaggaaaugacauugccaacugcuuaagaaagaauggaaaacgagugauucaauugagcaggaaaaccuuugauacagaguaucaaaaaacaaaaaauaacgacugggacuacgucgucacaacagacaucuccgaaaugggagcaaauuuccgggccgacagggugauagacccaagacggugucugaaaccgguaauauuaaaagaugguccagagcgugucauuuuggcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuuugagccggagagagaaaagagugcagcaauagacggggaauauagacugcggggugaagcaaggaaaacguuuguggagcucaugagaagaggagaccuaccugucuggcuguccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauacuagaaauagggaaacuuccacaacacuugacgcaaagggcccagaaugccuuggacaacuuggucauguugcacaacuccgaacaaggaggaagagccuauagacaugcaauggaagaacugccagacaccauagaaacauugaugcuccuugcuuugauagcuguguuaacugguggagugacgcuguucuuccuaucaggaaagggccuagggaaaacaucuaucggccuacucugcgugauggcuucaagcguacuacuauggauggccaguguggagccccauuggauagcggccuccaucauacuggaguucuuccuaaugguguugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccauugauggaauuguugcaauagauuuggacccugugguuuaugaugcaaaauuugagaaacaacuaggccaaauaauguuguugauacuaugcacaucacagauccucuugaugcggacuacaugggcccugugugaauccaucacacuggccacuggaccucugaccacgcuuugggagggaucuccaggaaaauuuuggaacaccacgauagcgguuuccauggcaaacauuuuuagaggaaguuaucuagcaggagcagguuuggccuucucauuaaugaaaucucuaggaggagguaggagaggcacgggagcccaaggggaaacacugggagagaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaacugaggugguuuguggagaggaaccuugugaaaccagaagggaaagucauagaccuugguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuucauaccaccugagaaaugugauacccuuuugugugauauuggugaguccucuccaaacccaacuauagaggaaggaagaacgcuacgcguucuaaagaugguggaaccauggcucagaggaaaccaauuuugcauaaagauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuuggacaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugaccgguucugggaccuugugcacagagagagggagcuucacaaacagggaaaaugugccacguguguuuacaacaugauggggaagagagaaaaaaaacuaggagaguucggaaaggcaaaaggaagucgugcaauaugguacaugugguugggagcacgcuuucuagaguuugaagcucuugguuucaugaacgaagaucacugguucagcagagagaauucacucagcggaguggaaggggaaggacuucacaaacuuggauauauacucagagacauaucaaagauuccagggggaaacauguaugcagaugacacagccggaugggauacaaggauaacagaggaugaccuccagaaugaggccaaaauuacugacaucauggaacccgaacaugcccuacuggcuaagucaaucuucaagcuaaccuaccaaaauaaggugguaaggguacagagaccagcaaaaaauggaaccgugauggaugucauauccagacgugaccagagaggaaguggccagguuggaaccuauggcuuaaacacuuucaccaacauggaagcccagcugauaagacaaauggagucugagggaaucuuuuuacccaacgaauuagagaccccaaauuuagccgggagaguucucgacuggcuggaaaaauauggcgucgaaaggcugaaaagaauggcaaucagcggagaugacugcguagugaaaccaauugaugauagguucgcgacagccuuaacagcucugaaugauaugggaaaaguaagaaaagacauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugacugggucccaaccagccgcaccaccuggucgauccaugcccaucaccaauggaugacaacagaagacaugcugucaguguggaauaggguuuggauagaggaaaacccauggauggaggacaaaacccguauauccaguugggaagauguuccauaucuaggaaaaagggaagaucaaugguguggaucucugauaggcuuaacagcaagggccaccugggccaccaacauacaaguggccauaaaccaagugagaagacuaauugggaaugagaauuauucagauuacaugacaucaaugaagagauucaagaacgagagugaacccgaaggggcacucugguga

SEQ ID NO: 5808 - RNA, 9879 nt, Artificial Sequence
  derived and/or modified CDS sequence (wt) from DENV-1__FJ461339__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugccaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuuaaaauguagacuaaagauggacaagcugacucuaaaagggaugucauauguaaugugcacaggcucauucaagcuagagaaagaaguggcugagacccagcauggaaccguucuaguacagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccacauucaucaucgacggcccaaacaccccagaaugcccugaugaccaaagagcauggaacauuugggaaguugaggacuauggauuuggaauuuucacgacaaauauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaauguugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauucccuggaggagcugggggauggacuugcaaugggcauuaugauuuugaaauuauugaccgacuuucaaccacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagagaacguguuccacacaauguggcaugucaccaggggagccguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggcuagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacgucgucacaacagauaucuccgaaaugggagcaaauuuccgggccgacagggugauagacccaagacggugucugaaaccgguaauacuaaaagaugguccagagcgugucauuuuagcaggaccgaugccagugacuguagccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaauaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauagcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguacugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggaguaggucuggccuucucauuaaugaaaucucuaggaggagguaggagaggcacgggagcccaaggggaaacacugggagagaaauggaagagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauauuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaauccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauuuacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacgugugucuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccucaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugacaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagagaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5809 - RNA, 9879 nt, Artificial Sequence
  derived and/or modified CDS sequence (wt) from DENV-1__FJ882515__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcaauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggccgagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuauuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagggagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagaugugcagaacaccaccuucaucaucgacggcccaaacaccccagaaugcccugaugaucaaagagcauggaacauuugggaaguugaggacuauggauuuggaauuuucacgacaaauauaugguugaaaaugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguaggaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaagagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucauccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaauuauggcuguuggaguagucagcauccuacuaaguucacuucuaaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagccguguugacugguggagugacgcuguucuuccuaucaggaaggggccuagggaaaacaucuaucggcuuacucugcgugauggcuucaagcguacugcuauggauggccaguguggaaccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucucgccuugggaugcuauucacaggugaauccacugacgcugacagcggcgguauugaugcuaguggcucacuacgccauaauuggaccuggauugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccauuacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguguucuuuacaccaccugagaaaugugacacccuuuugugugacauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaaaagacguggaccuaggcgcuggaacuagacauguggcaguggaaccagaaguagccaaccuggauaucauuggccagaggauagagaacauaaaacaugagcacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagugcaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagcgagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaacauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaacugugauggaugucauauccagacgugaccaaagaggaaguggccaggucggaacuuauggcuugaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaagugagaaaagauauaccacaaugggaaccuucaaaaggauggaaugacuggccacaagugccucauuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccacgcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgaggaugaucccgaaggggcacucugguga

SEQ ID NO: 5810 - RNA, 9879 nt, Artificial Sequence
  derived and/or modified CDS sequence (wt) from DENV-1__FJ882517__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauaccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaagaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuagugacauuauaccuaggagucaugguucaggcggauucaggauguguaauuaauuggaaagguagagaacucaaauguggaaguggcauuuuugucaccaaugaaguucacacuuggacagaacaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggucacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccugaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuucaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggacggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuaugccauaauuggaccuggacugcaagcaaaagcuacuagagaagcucaaaaaaggacagcggccggaauaaugaaaaauccaaccguugauggaauuguugcaauagauuuggauccugugguuuaugauacaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaucaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauuuacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaaugguguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggacacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccguaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5811 - RNA, 9879 nt, Artificial Sequence
  derived and/or modified CDS sequence (wt) from DENV-1__JQ287661__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcaauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggugcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggccgagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuauuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagggagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaaugucauguggaagcaaauaucaaaugaacugaaccacaucuuacuugaaaaugacaugaaauucacagugguuguuggagauguaguugggaucuuggcucaaggaaaaaaaaugauuaggccacaacccauggaacacaaauacucguggaaaagcuggggaaaagcuaaaaucauaggggcagaugugcagaacaccaccuucaucaucgacggcccaaacaccccagaaugcccugaugaucaaagagcauggaacauuugggaaguugaggacuauggauuuggaauuuucacgacaaauauaugguugaaaaugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguaggaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaagagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucauccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaauuauggcuguuggaguagucagcauccuacuaaguucacuucucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguauaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagccguguugacugguggagugacgcuguucuuccuaucaggaaggggccuagggaaaacaucuaucggcuuacucugcgugauggcuucaagcguacugcuauggauggccaguguggaaccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucucgccuugggaugcuauucacaggugaauccacugacgcugacagcggcgguauugaugcuaguggcucacuacgccauaauuggaccuggauugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccauuacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguucguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugacauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaaaagacguggaccuaggcgcuggaacuagacauguggcaguggaaccagaaguagccaaccuggauaucauuggccagaggauagagaacauaaaacaugagcacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagugcaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugaaaaaagagagggagcuucacaaacagggaaaaugugccacguguguuuacaacaugauggggaagcgagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaacauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaacugugauggaugucauauccagacgugaccaaagaggaaguggccaggucggaacuuauggcuugaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5812 - RNA, 9879 nt, Artificial Sequence
  derived and/or modified CDS sequence (wt) from DENV-1__FJ882518__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuagccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguucguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaggauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaagcaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaacuauugacugacuuucagucacaucagcugugggcuaccuugcuguccuugacauuuauuaaaacaacgcuuuccuuacacuaugcauggaagacaauggcuaugguauugucaauugcaucucucuuccccuuaugccuguccacgaccucccaaaaaacaacguggcuuccggugcuauugggaucucuuggaugcaaaccacuaaccauguuucuuauaacagaaaccaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggugguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaagccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaagacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacgacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuuugagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugcccuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuugggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuucacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcggccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggaggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaucaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaauccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5813 - RNA, 9879 nt, Artificial Sequence
  derived and/or modified CDS sequence (wt) from DENV-1__FJ882519__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagccaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuaucggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuagcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuucuucuaacaauuggauugagucuaguggcuucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugugaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauuuaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaagacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacaccuuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5814 - RNA, 9879 nt, Artificial Sequence
  derived and/or modified CDS sequence (wt) from DENV-1__FJ882520__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguugaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaaugguuguggacucuucggaaaaggaagucugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguuuuagugcagauuaaauacgaaggaacagaugcaccaugcaagauccccuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucauggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauugaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugagguuucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuguccuacaaaguugccucagaaggcuuccaguacuccgauagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauauuagagauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacaggcaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaauauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacagcuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugucuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5815 - RNA, 9879 nt, Artificial Sequence
  derived and/or modified CDS sequence (wt) from DENV-1__FJ882523__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggauacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccgucuugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuucaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacgaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguuccauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaauauuugggaaguugaggacuauggauuuggaauuuucacgacaaacauaugguugaaauugcgugacuccuacacccaagugugugaccaucggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucucacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuaucaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcaccgggcaccuucaagaccccugaaggugaaguuggagccauugcccuagauuuuaaacccggcacaucuggaucucccauagugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcuccuacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaggcagcugcgaucuucaugacagccacucccccaggaucaguggaggccuuuccacagagcaaugcaguuauccaagaugaggaaagagacaucccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccaaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuccgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgcgaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuuggauucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuucacccagcgaauuggagaucccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggcaaccugggccucuaacauacaaguggccauaaaccaagugagaagacuaauugggaaugagaauuaucuagauuacaugacaucaaugaagagauucaagaacgagggugaucccgaaggggcacucugguga

SEQ ID NO: 5816 - RNA, 9879 nt, Artificial Sequence
  derived and/or modified CDS sequence (wt) from DENV-1__FJ882524__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggauacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccgucuugcgcaaacugugcauugaagcuaaaauaucaaacaccaccaccgacucaagauguccaacacaaggagaagccacacuuauggaagaacaagacgcgaacuaugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuucaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguuccauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagaugugguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaauauuugggaaguugaggacuauggauuuggaauuuucacgacaaauauaugguugaaauugcgugacuccuacacccaagugugugaccaucggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucucacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuaucaaaacaacgcuuuccuuacacuaugcauggaagacaauggcuaugguacugucaauuguaucucucuuccccuuaugccuauccacgaccucucaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcaccgggcaccuucaagaccccugaaggugaaguuggagccauugcccuagauuuuaaacccggcacaucuggaucucccauagugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcuccuacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaggcagcugcgaucuucaugacagccacucccccaggaucaguggaggccuuuccacagagcaaugcaguuauccaagaugaggaaagagacaucccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccaaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuccgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacgcuguucuuccuaucaggaaggggccuagggaaaacaucuaucggcuuacucugcgugacggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgcgaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuuggauucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuucacccagcgaauuggagaucccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggcaaccugggccucuaacauacaaguggccauaaaccaagugagaagacuaauugggaaugagaauuaucuagauuacaugacaucaaugaagagauucaagaacgagggugaucccgaaggggcacucugguga

SEQ ID NO: 5817 - RNA, 9879 nt, Artificial Sequence
  derived and/or modified CDS sequence (wt) from DENV-1__FJ882525__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuguagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuagauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcguauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaauaggacaauugacauggaaugacuugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauucaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguauccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucguuacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaauuuugugaaaccagaagggaaagucauagaccucgguuguggaagagguggcuggucauacuauugcgccgggcugaagaaagucacagaagugaagggauauacgaaaggaggaccuggacaugaagagccaauuccaauggcgaccuauggauggaaccuaguaaaacugcacuccgggaaagacguguucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcgaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagauuauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5818 - RNA, 9879 nt, Artificial Sequence
  derived and/or modified CDS sequence (wt) from DENV-1__FJ882526__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacaucuaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucucacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaagagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugacgguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauccaauugagcagaaaaacuuuugauacagaguaccaaaaaacaaaaaacaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauucucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauaucuaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 5819 - RNA, 9879 nt, Artificial Sequence
  derived and/or modified CDS sequence (wt) from DENV-1__FJ882527__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaagggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaacuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaaugcuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuagccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccucuugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccgggcaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaccaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaaagaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaagugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5820 - RNA, 9879 nt, Artificial Sequence
  derived and/or modified CDS sequence (wt) from DENV-1__FJ882529__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuccuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggauaagcugacucuaaaggggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucggcagccaucgggaaggcaugggaggaggguguguguggaauacgaucagcaacucgucucgagaacaucauguggaagcaaauaucaaaugaacugaaccacaucuuacuugaaaaugacgugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaacugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacaaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcagaucccaaguagggguaggaguuuuccaagaaaacguguuccacacaauguggcaugucaccaggggagcuguacucauguaucaagggaagagacuggaaccgagcugggccagugucaaaaaggaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgucuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagaguaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagauggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagagagaaagaaacuaagaccccgcuggcuggaugcuagaacauacucagacccacuggcccugcgugaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaauugccagacaccauagaaacguugaugcuccuagcuuugauagcuguguuaacugguggagugacgcuguucuuccuaucaggaagaggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaauacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauucucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcuaaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaaugguucacaggaaaccaacguaugaaagagacguggaccuaggcgccggaacaagacauguggcaguggaaccugagguagcuaaccuagauaucauuggccagaggauagagaacauaaaacaugaacauaagucaacauggcauuaugaugaggacaauccauacaaaacaugggccuaccauggaucauaugaggucaagccaucaggaucagccucauccaugguuaauggcguggugaaacugcucaccaaaccaugggaugucauccccauggucacacaaauagccaugaccgacacuacacccuuuggacaacagaggguguucaaagagaaaguugacacacgcacaccaaaagcaaaacgaggcacagcacaaaucauggagguaacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5821 - RNA, 9879 nt, Artificial Sequence
  derived and/or modified CDS sequence (wt) from DENV-1__FJ882530__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugauguugauuguuggugcaaugccacagacacaugggugaccuauggaacauguucccaaacuggcgagcaccggcgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaagggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaacuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacgcuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccucuugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccgggcaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaccaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgcugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggccauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugauacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaaagaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaagugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagcuguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5822 - RNA, 9879 nt, Artificial Sequence
  derived and/or modified CDS sequence (wt) from DENV-1__GQ868605__SS-prME
ucugugaccaugcuacuuaugcugaugcccacagccuuggcguuucaucugacuacacgagggggagagccgcauaugauaguuaccaagcaggaaagaggaaagucacuuuuguuuaagaccucaguaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuccuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaggacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaauuugaaauauucaguaauagucaccguccacacuggagaccagcaccaggugggaaaugaaagcacagaacaugggacaaccgcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcaucgcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaacaucauguggaagcaaauaucaaaugaacugaaccacaucuuacuugaaaacgacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacucaagugugugaccaccggcuaaugucagcugccaucaaggacagcaaggcaguucaugcugacaugggguacuggauagaaagugaaaagaacgauaccuggaagcuggcaagagccucuuucauagaaguuaaaacaugcauuuggccaaaaucccauacucuauggagcaauggaguucuggaaagugaaaugauaauuccaaagaucuauggaggaccaauaucucagcacaacuacagaccaggauauuucacacaaacggcagggccguggcaucuagguaaguuggaacuggauuuugauuugugugaggguaccacaguuguuguggaugaacauuguggaaaucgaggaccaucccuuagaaccacaacagucacaggaaagauaauucaugaaugguguugcagaucuuguacacuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaagcauaucaauaaugaucgaagaggugaugagauccagauggaguagaaaaaugcugaugacuggaacacuggcuguguuccuccuucucauaguggggcaauugacauggaaugaucugaucagauuaugcaucaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcugucuuugacauuuauuaaaacagcgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccucaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagcuauaguccgugaggccauaaaaaggaagcugcgcacacuaauuuuggcuccuacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugaaacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguucagagcgugucauucuagcaggaccgaugccaguaacuguggccagugccgcccaaaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauaauagaaauagggaaacuuccacaacauuugacgcaaaaggcccagaaugcuuuggacaaccuggucauguugcacaacuccgaacaaggaggaagagccuauagacaugcaauggaagaauugccagacaccauagaaacguugaugcuccuagcuuugauagcuguauugacugguggagugacgcuguucuuccuaucaggaaggggccuagggaaaacaucuaucggcuuacucugcgugauggcaucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuucuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggccuggccuucucauuaaugaaaucuuuaggaggagguaggagaggcacgggagcccaaggagaaacacugggagagaaauggaaaaggcagcugaaccaacugagcaagucagaauucaacaucuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuauggaguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuuggcuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5823 - RNA, 9879 nt, Artificial Sequence
  derived and/or modified CDS sequence (wt) from DENV-1__FJ882534__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagagcuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauuuacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaccacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagaucaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauaguagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucucugaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaucugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuuggcuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucuugauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaccccgaaggggcacucugguga

SEQ ID NO: 5824 - RNA, 9879 nt, Artificial Sequence
  derived and/or modified CDS sequence (wt) from DENV-1__FJ882536__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaaaauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcgcgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucuuauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugccuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccccugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcucaaggggaaacacugggagaaaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaccaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugauccugaaggggcacucugguga

SEQ ID NO: 5825 - RNA, 9879 nt, Artificial Sequence
  derived and/or modified CDS sequence (wt) from DENV-1__FJ882537__SS-prME
ucugugaccaugcuccuuaugcugaugccuacagccuuggcauuccauuugacuacacgaggaggagagccgcacaugauaguuagcaagcaggaaagaggaaagucacuuuuguucaaaaccucagcaggugucaacaugugcacccucauagcgauggauuugggagaguuaugugaggacacaaugacuuacaaauguccucgaauuacugagguggaaccagaugacguugauuguuggugcaacaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcccugagacacccaggauucacggugauagcccuuuuucuagcacaugccauaggaacauccaucacccagaaagggauuauuuucauucuguuaaugcugguaacaccuuccauggccaugcgaugcgugggaauaggcagcagggacuucguggaagggcugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaauuugaaauauucaguaauagucaccguccacacuggagaccagcaccaggugggaaaugaaagcacagaacaugggacaauugcaacuauaacaccucaagcuccuacgucggaaauacagcugaccgacuacggagcucuuacauuggacugcucaccuagaacaggacuggacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgaccggaacgacaacaauuuuugcaggacaccugaaauguagacuaaagauggacaaacugacucuaaaagggaugucauaugugaugugcacagguucauucaagcuagagaaagaaguggcugagacccagcauggaaccguucuagugcagauuaaauacgaaggaacagaugcaccaugcaagaucccuuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaauaacacuauaccuaggagucaugguucaggcggauucaggauguguaauuaauuggaaggguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugguuaggccacaacccauggaacacaaauacucguggaaaagcuggggaaaagccaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauuacgugacuccuacacccaaguaugugaccaccggcuaaugucagcugccaucaaggacagcaaggcaguucacgcugauaugggguacuggauagaaagugaaaagaaugagaccuggaaguuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggauguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacauuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacguggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcacuuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaccaguacaucuacaugggacagccuuuaaacaacgaugaagaucacgcccacuggacagaagcaaaaaugcuccuugauaauauaaacacaccagaagggaucaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaaaaaacuacgaccccgcuggcuagaugccagaacauacucagacccacuggcccugcgcgaguuuaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucuagccuuggggugcuauucucaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggaccccgugguuuaugaugcaaaauuugagaaacaauuaggccaaauaauguuguugauacuaugcacaucacagauccuuuugaugcggacuacaugggccuugugcgaauccaucacacuggccacuggaccccugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaagaaggaagaacguuacgcguccuaaagaugguggaaccauggcucagaggaaaccaauucugcauaaagauucugaauccuuacaugccaagugugguggaaacccuggaacauaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacaccacacccuuuggacaacagaggguguuuaaagagaaaguugacacacguacaccaaaagcaaaacgaggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugagcgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaauauggcgucgaaaggcuaaaaagaauggcaaucagcggagaugacugcguggugaaaccaauugaugacagguuugcaacagccuuaacagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5826 - RNA, 9879 nt, Artificial Sequence
  derived and/or modified CDS sequence (wt) from DENV-1__GQ868606__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauugaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaaccacagaccaggauauuucacacaaacggcagggccguggcaccuaggcaagcuggaacuggauuuugauuugugugaggguaccacaguuguuguggaugaacauuguggaaaccgaggaccaucucucaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuggcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaagaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggugucgaaaggcugaaaagaauggcaaucagcggagaugacugcguagugaaaccaauugaugauagguuugcaacagccuuaacagcccugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5827 - RNA, 9879 nt, Artificial Sequence
  derived and/or modified CDS sequence (wt) from DENV-1__FJ882539__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauugcuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggauguggacucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgauuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuuuagcaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaauaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacaugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaaccacagaccaggauauuucacacaaacggcagggccguggcaccuaggcaaguuggaacuggauuuugauuugugugaggguaccacaguugucguggaugaacauuguggaaaucgaggaccaucucuuaggaccacaacaguuacaggaaagauaauucaugaauggugcugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacauuuuccuugcacuaugcauggaagacaauggccaugguacugucaauuguaucucucuuccccuuaugccugucuacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaaggggaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcggcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcucagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucuaguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuacgcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggaucccgugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggccuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaacucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuucacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5828 - RNA, 9879 nt, Artificial Sequence
  derived and/or modified CDS sequence (wt) from DENV-1__FJ882541__SS-prME
ucugugaccaugcuccuuaugcugauaccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaauaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagucugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugagaugguguuguugacaaugaaaggaaaaucauggcuaguccacaaacaaugguuucuagaccuaccauugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguuuuagugcagauuaaauacgaaggaacagaugcaccaugcaagauccccuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauauugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaagagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugagguuucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaggggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguaauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaaguugccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauauuagagauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuugggguguuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucuaaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacguacaccaaaagcaaaacggggcacugcacaaaucauggaggugacagccaggugguuaugggguuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugucuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5829 - RNA, 9879 nt, Artificial Sequence
  derived and/or modified CDS sequence (wt) from DENV-1__FJ882542__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuagccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaggauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaagcaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuucucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggagauggacuugcaaugggcauuaugauuuuaaaacuauugacugacuuucagucacaucagcugugggcuaccuugcuguccuugacauuuauuaaaacaacgcuuuccuuacacuaugcauggaagacaauggcuaugguauugucaauugcaucucucuuccccuuaugccuguccacgaccucccaaaaaacaacguggcuuccggugcuauugggaucucuuggaugcaaaccacuaaccauguuucuuauaacagaaaccaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggugguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugauggcaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaagccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacgacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugcccuggacaaccuggucauguugcacaacuccgaacaaggaggaagagccuauagacaugcaauggaagaauugccagacaccauagaaacguugaugcuccuagcuuugauagcuguguugacugguggaaugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuugggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuucacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcggccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccaggaggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaaggauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaauccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5830 - RNA, 9879 nt, Artificial Sequence
  derived and/or modified CDS sequence (wt) from DENV-1__FJ882543__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcaauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggccgagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuauuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagggagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguuggagauguaguugggaucuuggcucaaggaaaaaaaaugauuaggccacaacccauggaacacaaauacucguggaaaagcuggggaaaagcuaaaaucauaggggcagaugugcagaacaccaccuucaucaucgacggcccaaacaccccagaaugcccugaugaucaaagagcauggaacauuugggaaguugaggacuauggauuuggaauuuucacgacaaauauaugguugaaaaugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaaccacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguaggaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaagagcugggagauggacuugcaaugggcauuaugauuuuaaaauuauugacugacuuucagucacaucagcugugggcugccuugcuguccuugacauuuauuaaaacaacgcuuuccuuacacuaugcauggaagacaauggcuaugguacugucaauuguaucucucauccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaauuauggcuguuggaguagucagcauccuacuaaguucacuucucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauugguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacacccagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacauccggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagaguaaugcaguuauccaagaugaggaaagagacauuccugagagaucauggaacucaggauaugaguggaucacugacuuccuagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcguguuauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagccguguugacugguggagugacgcuguucuuccuaucaggaaggggccuagggaaaacaucuaucggcuuacucugcgugauggcuucaagcguacugcuauggauggccaguguggaaccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucucgccuugggaugcuauucacaggugaauccacugacgcugacagcggcgguauugaugcuaguggcucacuacgccauaauuggaccuggauugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccauuacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugacauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaaaagacguggaccuaggcgcuggaacuagacauguggcaguggaaccagaaguagccaaccuggauaucauuggccagaggauagagaacauaaaacaugagcacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagugcaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugaaaaaagagagggagcuucacaaacagggaaaaugugccacguguguuuacaacaugauggggaagcgagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaacauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaacugugauggaugucauauccagacgugaccaaagaggaaguggccaggucggaacuuauggcuugaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguugggaagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5831 - RNA, 9879 nt, Artificial Sequence
  derived and/or modified CDS sequence (wt) from DENV-1__FJ882544__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcucuuuuucuagcacaugccauaggaacauccaucacccagaaagggauuauuuucauuuuguuaaugcugguaacaccauccauggccaugcgaugcgugggaauaggcaacagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaaggaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauuagaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggagcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacccuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaagugggaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuauuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaagaggaguggaauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcaaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaacauuccagggggaaacauguaugcagaugacacagccggaugggauacaaggauaacagaggaugaccuucagaaugaggccagaauuacugacaucauggaaccugaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5832 - RNA, 9879 nt, Artificial Sequence
  derived and/or modified CDS sequence (wt) from DENV-1__FJ898371__SS-prME
ucugugacuaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacuaaacuggaaggaaagauaguucaauaugaaaacuugaaauauucaguaauagucaccguccacacuggagaccagcaccaggugggaaaugaaagcacagaacaugggacaacugcaacuauaacaccccaagcucccacgucggaaauacagcugaccgacuacggagcucucacauuggauugcucacccagaacaggacuagacuuuaaugaaaugguguuguugacaaugaaagaaaaaucauggcuaguccauaaacaaugguuucuagaccuaccauugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuuugacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaaccgcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacucccacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggccaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaauuauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacuuauguaccaagggaagagacuagaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggaucaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuucaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcugugcugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuuaaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccugggcaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaauccuuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguuguuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguagugaaacugcucaccaaaccaugggaugucauccccauggucacacaaauagcuaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagacccaaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggagaacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5833 - RNA, 9879 nt, Artificial Sequence
  derived and/or modified CDS sequence (wt) from DENV-1__FJ882545__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaaccauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcagauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugagucaucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcugggaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccacauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5834 - RNA, 9879 nt, Artificial Sequence
  derived and/or modified CDS sequence (wt) from DENV-1__FJ898372__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccugauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaagagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagagguuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaucaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagaucccuuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcagauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucccccgugagaguucccaauuacaacaugauuaucauggaugaagcacauuuuacagauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugacaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugagucaucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5835 - RNA, 9879 nt, Artificial Sequence
  derived and/or modified CDS sequence (wt) from DENV-1__FJ898373__SS-prME
ucugugaccaugcuccuuaugcugaugccuacagccuuggcauuccauuugacuacacgaggaggagagccgcacaugauaguuagcaagcaggaaagaggaaagucacuuuuguucaaaaccucagcaggugucaacaugugcacccucauagcgauggauuugggagaguuaugugaggacacaaugacuuacaaauguccucgaauuacugagguggaaccagaugacguugauuguuggugcaacaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcccugagacacccaggauucacgguaauagcccuuuuucuagcacaugccauaggaacauccaucacccagaaagggauuauuuucauucuguuaaugcugguaacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaauuugaaauauucaguaauagucaccguccacacuggagaccagcaccaggugggaaaugaaagcacagaacaugggacaauugcaacuauaacaccucaagcuccuacgucggaaauacagcugaccgacuacggagcucuuacauuggacugcucaccuagaacaggacuggacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgaccggaacgacaacaauuuuugcaggacaccugaaauguagacuaaagauggacaaacugacucuaaaagggaugucauaugugaugugcacagguucauucaagcuagagaaagaaguggcugagacccagcauggaaccguucuagugcagauuaaauacgaaggaacagaugcaccaugcaagaucccuuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaauaacacuauaccuaggagucaugguucaggcggauucaggauguguaauuaauuggaaggguagagaacucaaauguggaaguggcauuuuugucaccaaugaaguccacacuuggacagagcaauacaaauuucaagcugacuccccaaagagacuaucagcagccgucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugguuaggccacaacccauggaacacaaauacucguggaaaagcuggggaaaagccaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauuacgugacuccuacacccaaguaugugaccaccggcuaaugucagcugccaucaaggacagcaaggcaguucacgcugauaugggguacuggauagaaagugaaaagaaugagaccuggaaguuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcaggcccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggauguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacauuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacguggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcacuuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagccuuuaaacaacgaugaagaucacgcccacuggacagaagcaaaaaugcuccuugauaauauaaacacaccagaagggaucaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaaggaaaaaacuacgaccccgcuggcuagaugccagaacauacucagacccacuggcccugcgcgaguuuaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggaccccgugguuuaugaugcaaaauuugagaaacaauuaggccaaauaauguuguugauacuaugcacaucacagauccuuuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaagaaggaagaacguuacgcguccuaaagaugguggaaccauggcucagaggaaaccaauucugcauaaagauucugaaucccuacaugccaagugugguggaaacccuggaacauaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaccuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacaccacacccuuuggacaacagaggguguuuaaagagaaaguugacacacgcacaccaaaagcaaaacgaggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugagcgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacuggcuggaaaaauauggcgucgaaaggcuaaaaagaauggcaaucagcggagaugacugcguggugaaaccaauugaugacagguuugcaacagccuuaacagcucugaaugauaugggaaaagugagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5836 - RNA, 9879 nt, Artificial Sequence
  derived and/or modified CDS sequence (wt) from DENV-1__FJ898374__SS-prME
ucugugaccaugcugcucaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguagauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagucacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacacaaccuucaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccgguuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggagagugaaaugguaauuccaaaaaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaacgaugugccgcuagcugggccacuaauagcuggaggcaugcuaauagcauguuauguuauaucuggaagcucagcugacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaggaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagguccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacucgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggauguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacacuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaauuuguacaagagaggaguucacaaggaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuaccgacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaaugagggugaucccgaaggggcacucugguga

SEQ ID NO: 5837 - RNA, 9879 nt, Artificial Sequence
  derived and/or modified CDS sequence (wt) from DENV-1__FJ898375__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauggcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagauaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauuuaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacaguggucguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuauacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucucacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggggccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaacaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuaucccacaaaguugccucagaaggcuuucaguacucugacagaagauggugcuuugauggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauaggucuauuauucaugauacugacaguagcagccaaugagaugggacugcuggaaaccacaaagaaagacuuagggauuggccauguggcuguugaaaagcaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaagaacagcggccggaauaaugaaaaauccaaccguugauggaauuguugcaauagauuuggaucccgugguuuaugaugcaaaauuugagaaacaacuaggccaaauaauguuguuaauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuauaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuuguacacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagauauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5838 - RNA, 9879 nt, Artificial Sequence
  derived and/or modified CDS sequence (wt) from DENV-1__FJ898376__SS-prME
ucugugacuaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguucugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacuaaacuggaaggaaagauaguucaauaugaaaacuugaaauauucaguaauagucaccguccacacuggagaccagcaccaggugggaaaugaaagcacagaacaugggacaacugcaacuauaacaccccaagcucccacgucggaaauacagcugaccgacuacggagcucucacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagacuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagaucuuuggaaccgcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugagguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauuuacagugguuguaggagauguaguugggaucuuggcucaagggaaaaaaaugaucaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacucccacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucgauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuagccauguuucuuauagcagaaaacaaaaucuggggaaggaaaaguuggccccucaaugaaggaauuauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaacauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacuuauguaccaagggaagagacuagaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgcgucauucuagcaggaccgaugccaguaacuguagccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggaucaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagugucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcugugcugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacagcuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaauccuuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguuacuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguagugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuuuaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugaaggaaucuuuuuacccagcgaauuggagacccaaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaacuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggcuuccaacauacaaguggccauaaaccaagugagaagacuaauugggaaugagaauuaucuagauuacaugacaucaaugaagagauucaagaacgagggugaucccgaaggggcacucugguga

SEQ ID NO: 5839 - RNA, 9879 nt, Artificial Sequence
  derived and/or modified CDS sequence (wt) from DENV-1__FJ898379__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaagugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuucuuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaaucaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuagaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaacugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaagcuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacauccggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaauaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagcgccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggugaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcucugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccggagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaacuuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcguugaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacuuugguga

SEQ ID NO: 5840 - RNA, 9879 nt, Artificial Sequence
  derived and/or modified CDS sequence (wt) from DENV-1__GQ199773__SS-prME
ucugugaccaugcuucuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauugcuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagauaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaacagucaccguccacacuggagaccagcaccaggugggaaaugaaagcacagaacaugggacaacugcaacuauaacaccucaagcuccuucgacggaaauacagcugaccgauuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcauacugcguugaccggagcaacagaaauccaaacgucuggaacgacaacaauuuuugcaggacacuugaaauguagacuaaagauggacaagcugacucuaaaagggaugucauauguaaugugcacaggcucauuuaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacaugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguugucguggaugaacauuguggaaaucgaggaccaucucuuaggaccacaacaguuacaggaaagauaauucaugaauggugcugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacauuuuccuugcacuaugcauggaagacaauggccaugguacugucaauuguaucucucuucccuuuaugccugucuacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaaggggaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcggcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcucagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucuaguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuacgcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggaucccgugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaacucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucuggaaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5841 - RNA, 9879 nt, Artificial Sequence
  derived and/or modified CDS sequence (wt) from DENV-1__JF937596__SS-prME
ucugugaccaugcuacuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaaaacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacacaaccuucaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugguaauuccaaaaaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguugccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguaggaguaggagucuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaauagagaaggaaaaauaguaggucuuuauggaaauggaguggugacaacaaguggaaccuacgucagugccauagcucaaaccaaagcaucacaagaagguccccuaccagagauugaagaugagguguuuaggaaaagaaacuuaacaauaauggaccuacauccaggaucggggaaaacaagaagauaccucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuacugucuccugugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggacaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugccugaaaccgguaauacuaaaagaugguccagagcgugucauucuagcaggaccgaugccaguaacuguggccagugccgcccagaggagaggaagaauuggaaggaaccacaauaaggaaggugaucaguacauuuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuacccguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguggacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaacugccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuugcaccaccugagaaaugugacacacuuuugugugauauuggugaguccucuccaaacccaaccauagaagaaggaagaacguuacgcguccuaaaaaugguggaaccauggcucagagggaaccaauucugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccaugguuacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagagaaauaguggugccaugccguaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5842 - RNA, 9879 nt, Artificial Sequence
  derived and/or modified CDS sequence (wt) from DENV-1__FJ898380__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguugugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucaaaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccaguguaaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugcugcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcucuuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5843 - RNA, 9879 nt, Artificial Sequence
  derived and/or modified CDS sequence (wt) from DENV-1__FJ898382__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcauugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauucaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucguuacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaagugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggauccccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5844 - RNA, 9879 nt, Artificial Sequence
  derived and/or modified CDS sequence (wt) from DENV-1__FJ898383__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccaaucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5845 - RNA, 9879 nt, Artificial Sequence
  derived and/or modified CDS sequence (wt) from DENV-1__FJ898384__SS-prME
ucugugaccaugcuccuuaugcugaugcccacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggaaacuugggcccugagacacccaggauucacggugauagccauuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaauuugaaauauucaguaauagucaccguccacacaggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacugaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaauuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacauuuuacuugaaaaugacaugaaacucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucgauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaucacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagccgggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguucucauguaucaagggaagagacuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuucaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacggguaauucaauugagcaggaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggaucggccauguggcuguugaaaaucaccaccaugccgcaaugcuggacguggacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcuaacagcggcgguauugaugcuaguggcucauuacgccauaauuggaccuggacugcaagcaaaagcuaccagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugaguaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggugccggaacaagacauguggcaguggaaccagagguagccaaccuagauaucauuggccagaggauagagaacauaaaacaugaacauaagucaacauggcauuaugaugaggacaacccauauaaaacaugggccuaccauggaucauaugaggucaagccgucaggaucagccucauccauggucaauggcguggugaaacugcucaccaaaccaugggaugucauccccauggucacacaaauagccaugacugacaccacacccuuuggacaacagaggguguuuaaagagaaaguugacacacgcacaccaaaagcaaaacgaggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacgugcguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagauucaagaaugagagugauccugaaggggcacucugguga

SEQ ID NO: 5846 - RNA, 9879 nt, Artificial Sequence
  derived and/or modified CDS sequence (wt) from DENV-1__FJ898385__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggauacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuucaaugaaaugguguuguugacaaugaaagaaaaaucauggcuaguccacaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguuccauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggucuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagguguaguugggaucuuggcucaagggaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaucggcuaaugucggcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugagggcaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucucacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuaucaaaacaacgcuuuccuuacacuaugcauggaagacaauggcuaugauacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccguuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacaugggagaagaagugcaggugauugcuguugaaccaggaaaaaaccccaaaaauguacaaacagcaccgggcaccuucaagaccccugaaggugaaguuggagccauugcccuagauuuuaaacccggcacaucuggaucucccauagugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcuccuacaaggguugucgcuuccgaaauggcagaggcgcucaagggaaugccaauaagauaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaggcagcugcgaucuucaugacagccacucccccaggaucaguggaggccuuuccacagagcaaugcaguuauccaagaugaggaaagagacaucccugagagaucauggaacucaggauaugaguggaucacugacuuuccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccaaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuccgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacauugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgcgaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuagugaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuuggauucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaaucacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuucacccagcgaauuggagaucccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauguaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggcaaccugggccucuaacauacaaguggccauaaaccaagugagaagacuaauugggaaugagaauuaucuagauuacaugacaucaaugaagagauucaagaacgagggugaucccgaaggggcacucugguga

SEQ ID NO: 5847 - RNA, 9879 nt, Artificial Sequence
  derived and/or modified CDS sequence (wt) from DENV-1__GQ868608__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuuaggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcaaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaagcauggcuaguccacaaacaaugguuccuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagauaccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaucagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcauggaaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucauggaaaagcuggggaaaggcuaaaaucauaggggcagaugugcagaaugccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcaggaccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcauuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacaugcuaaccauucuccugaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuucugucucccgugagaguucccaauuacaacaugauuaucauggaugaagcacauuucaccgauccauccagcauagcggccagaggguacaucucaacccgaguggguaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaauaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagagggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucagggaggggccuagggaaaacaucuaucggccuacucugugugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugauacaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcggucuccauggcaaacauuuuuagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacuuuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagauugauccugaaggggcacucugguga

SEQ ID NO: 5848 - RNA, 9879 nt, Artificial Sequence
  derived and/or modified CDS sequence (wt) from DENV-1__GQ199774__SS-prME
ucugugaccaugcuccuuaugcugaugccuacagccuuggcauuccauuugacuacacgaggaggagagccgcacaugauaguuagcaagcaggaaagaggaaagucacuuuuguucaaaaccucagcaggugucaauaugugcacccucauagcgauggauuugggagaguuaugugaggacacaaugacuuacaaauguccucgaauuacugagguggaaccagaugacguugauuguuggugcaacaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacagaaaguggagacuugggcccugagacacccaggauucacggugauagcccuuuuucuagcacaugccauaggaacauccaucacccagaaagggauuauuuucauucuguuaaugcugguaacaccuuccauggccaugcgaugcgugggaauaggcagcagggacuucguggaagggcugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaauuugaaauauucaguaauagucaccguccacacuggagaccagcaccaggugggaaaugaaagcacagaacaugggacaauugcaacuauaacaccucaagcuccuacgucggaaauacagcugaccgacuacggagcucuuacauuggacugcucaccuagaacaggacuggacuuuaaugaaaugguguuguugacaaugaaagaaaaaucauggcuaguccacaaacaaugguuucuagaccugccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgaccggaacgacaacaauuuuugcaggacaccugaaauguagacuaaagauggacaaacugacucuaaaagggaugucauaugugaugugcacagguucauucaagcuagagaaagaaguggcugagacccagcauggaaccguucuagugcagauuaaauacgaaggaacagaugcaccaugcaagaucccuuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaauaacacuauaccuaggagucaugguucaggcggauucaggauguguaauuaauuggaaggguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugguuaggccacaacccauggaacacaaauacucguggaaaagcuggggaaaagccaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauuacgugacuccuacacccaaguaugugaccaccggcuaaugucagcugccaucaaggacagcaaggcaguucacgcugauaugggguacuggauagaaagugaaaagaaugagaccuggaaguuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggauguugguacgguauggaaaucagaccagucagggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacauuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacguggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccuaaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucacaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcacuuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaccaguacaucuacaugggacagccuuuaaacaacgaugaagaucacgcccacuggacagaagcaaaaaugcuccuugauaauauaaacacaccagaagggaucaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaaaaaacuacgaccccgcuggcuagaugccagaacauacucagacccacuggcccugcgcgaguuuaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucuagccuuggggugcuauucucaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggaccccgugguuuaugaugcaaaauuugagaaacaauuaggccaaauaauguuguugauacuaugcacaucacagauccuuuugaugcggacuacaugggccuugugcgaauccaucacacuggccacuggaccccugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaagaaggaagaacguuacgcguccuaaagaugguggaaccauggcucagaggaaaccaauucugcauaaagauucugaauccuuacaugccaagugugguggaaacccuggaacauaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacaccacacccuuuggacaacagaggguguuuaaagagaaaguugacacacguacaccaaaagcaaaacgaggcacugcacaaaucauggaggugacagccaggugguuauggggcuuucuuuccagaaacaaaaaaccaagaauuuguacaagagaggaguucacaagaaaaguuaggucaaacgcagccauuggagcaguguucguugaugaaaaucaauggaacucagcaaaagaagcgguggaagaugagcgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacugguuggaaaaauauggcgucgaaaggcuaaaaagaauggcaaucagcggagaugacugcguggugaaaccaauugaugacagguuugcaacagccuuaacagcucugaaugauaugggaaaaguaagaaaagauauaccacaaugggaacccucaaaaggauggaaugauuggcaacaagugccuuuuuguucacaccacuuccaccaguugauuaugaaggauggaagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5849 - RNA, 9879 nt, Artificial Sequence
  derived and/or modified CDS sequence (wt) from DENV-1__GQ199775__SS-prME
ucugugaccaugcuccuuaugcugaugccuacagccuuggcauuccauuugacuacacgaggaggagagccgcacaugauaguuagcaagcaggaaagaggaaagucacuuuuguucaaaaccucagcaggugucaauaugugcacccucauagcgauggauuugggagaguuaugugaggacacaaugacuuacaaauguccucgaauuacugagguggaaccagaugacguugauuguuggugcaacaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacagaaaguggagacuugggcccugagacacccaggauucacggugauagcccuuuuucuagcacaugccauaggaacauccaucacccagaaagggauuauuuucauucuguuaaugcugguaacaccuuccauggccaugcgaugcgugggaauaggcagcagggacuucguggaagggcugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguuuguggacagaggcuggggcaauggcugugggcucuucggaaaaggaagccugauaacgugugcuaaguucaagugugugacaaaacuggaaggaaagauaguucaauaugaaaauuugaaauauucaguaauagucaccguccacacuggagaccagcaccaggugggaaaugaaagcacagaacaugggacaauugcaacuauaacaccucaagcuccuacgucggaaauacagcugaccgacuacggagcucuuacauuggacugcucaccuagaacaggacuggacuuuaaugaaaugguguuguugacaaugaaagaaaaaucauggcuaguccacaaacaaugguuucuagaccugccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgaccggaacgacaacaauuuuugcaggacaccugaaauguagacuaaagauggacaaacugacucuaaaagggaugucauaugugaugugcacagguucauucaagcuagagaaagaaguggcugagacccagcauggaaccguucuagugcagauuaaauacgaaggaacagaugcaccaugcaagaucccuuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcaguuggucuaauaacacuauaccuaggagucaugguucaggcggauucaggauguguaauuaauuggaaggguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugguuaggccacaacccauggaacacaaauacucguggaaaagcuggggaaaagccaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauuacgugacuccuacacccaaguaugugaccaccggcuaaugucagcugccaucaaggacagcaaggcaguucacgcugauaugggguacuggauagaaagugaaaagaaugagaccuggaaguuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggauguugguacgguauggaaaucagaccagucagggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacauuggcuguguucuuccuucucauaaugggacaauugacauggaaugaucugaucaggucaugcaucaugguuggagccaacgcuuccgacaggauggggaugggaacgacguaccuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacguggcucccggugcuauugggaucucuuggaugcaaaccacuaaccauguuucuuauagcagaaaacaaaaucuggggaaggaaaaguuggccccucaaugaaggaaucauggcuguuggcauagucagcauccuacuaaguucacuccuaaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucacaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcacuuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaggaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggccgacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaccaguacaucuacaugggacagccuuuaaacaacgaugaagaucacgcccacuggacagaagcaaaaaugcuccuugauaauauaaacacaccagaagggaucaucccagcccucuucgaaccggagagagaaaagagugcagcaauagacggggaauacagacugcggggugaagcaaggaaaacguuuguggagcucaugagaagaggagaucuaccugucuggcuauccuacaaaguugccucagaaggcuuccaguacuccgacagaagauggugcuuugacggggaaaggaacaaccagguguuggaggagaacauggacguggagaucuggacaaaagaaggagaaagaaaaaaacuacgaccccgcuggcuagaugccagaacauacucagacccacuggcccugcgcgaguuuaaagaguuugcagcaggaagaagaagcgucucaggugauuuaauauuagaaauagggaaacuuccacaacacuugacgcaaagggcccagaaugccuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaggggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauucaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucuagccuuggggugcuauucucaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggaccccgugguuuaugaugcaaaauuugagaaacaauuaggccaaauaauguuguugauacuaugcacaucacagauccuuuugaugcggacuacaugggccuugugcgaauccaucacacuggccacuggaccccugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaagaaggaagaacguuacgcguccuaaagaugguggaaccauggcucagaggaaaccaauucugcauaaagauucugaauccuuacaugccaagugugguggaaacccuggaacauaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacaccacacccuuuggacaacagaggguguuuaaagagaaaguugacacacguacaccaaaagcaaaacgaggcacugcacaaaucauggaggugacagccaggugguuauggggcuuucuuuccagaaacaaaaaaccaagaauuuggacaagagaggaggucacaagaaaaguuaggucaaacgcaggcauuggagcaggggucggugaugaaaaucaauggaacucagcaaaaaaagggguggaagaugagcgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagccggaugggauacaaggauaacagaggaugaccuucagaaugaggccaaaauuacugacaucauggagccugaacaugcccuacuggcuacgucaaucuucaagcugaccuaccaaaauaaggugguaaggguacagagaccagcaaaaaauggaaccgugauggaugucauauccagacgugaccagagaggaaguggccaggucggaacuuauggcuuaaacacuuucaccaacauggaagcccagcuaauaagacaaauggagucugagggaaucuuuucacccagcgaguuggagaccccaaauuuagccgagagaguucucgacugguuggaaaaauauggcgucgaaaggcuaaaaagaauggcaaucagcggagaugacugcguggugaaaccaauugaugacagguuugcaacagccuuaacagcucugaaugauaugggaaaaguaagaaaagauauaccacaaugggaacccucaaaaggauggaaugauuggcaacaagugccuuuuuguucacaccacuuccaccaguugauuaugaaggauggaagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugaucccgaaggggcacucugguga

SEQ ID NO: 5850 - RNA, 9876 nt, Artificial Sequence
  derived and/or modified CDS sequence (wt) from DENV-1__FJ882546__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacauguguacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcagauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaaaaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggucuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggagaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucucugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugagucaucuccaaacccaacuauagaggaaggaagaacgcuacgcguccuaaagaugguggaaccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccauggucacacaaauagccaugacugaacuacaccuugggcaacagaggguguuuaaagagaaaguugacacacgcacaccacgagcaaaacgagguacagcacaaaucauggagaugacagccaggugguuauggggauuucuuucuagaaacaagauaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacgcuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugaggaaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccacuaacauacaaguggcuauaaaccaagugagaagacuaauugggaaugagaauuaucuagauuacaugacaucaaugaagagauucaagaacgagagugaucccgaaggggcacucugguga

SEQ ID NO: 5851 - RNA, 9879 nt, Artificial Sequence
  derived and/or modified CDS sequence (wt) from DENV-1__KF921935__SS-prME
ucugugaccaugcuccuuaugcugaugccuacagcuuuggcguuccauuugaccacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaagcagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacuaugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaauuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuucgcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuuugacccaagaugaaaaaggaguaacccagaaugggagauugauaacagcuaaccccauaguuacugacaaagaaaaaccugucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguccaggcggauucaggauguguaauuaauuggaaagguagagaacucaaauguggaaguggcauuuuugucaccaaugaaguccacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaaagaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauucccacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuauccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagacuugaucucauauggaggagguuggaggcuucaaggauccuggaacacaggagaagaagugcaggugauugcuguugaaccagggaaaaaccccaaaaacguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugaccguggccagugccgcccagaggagaggaagaauuggaaggaaccacaauaaggaaggugaucaguacaucuacaugggacagccucuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguucugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugagacacacaaucgaaaacacaacggcaaauauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaaaucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagauagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacaacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggggcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuggccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagggugaucccgaaggggcacucugguga

SEQ ID NO: 5852 - RNA, 9879 nt, Artificial Sequence
  derived and/or modified CDS sequence (wt) from DENV-1__GQ199776__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaguacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaccagcugugggcuaccuugcuguccuugacauuuaucaaaacaacgcuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagccgggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacaugugguaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5853 - RNA, 9879 nt, Artificial Sequence
  derived and/or modified CDS sequence (wt) from DENV-1__GQ199777__SS-prME
ucugugaccaugcuccuuaugcugaugccuacagccuuggcguuccauuugacuacacgagggggagagccgcacaugauagucagcaagcaggaaagaggaaaaucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuuaaagacggaagucacaaacccugccguccugcgcaaacugugcauugaagcuaaaauaucaaacaccaccaccgacucaagauguccaacacaaggagaagccacacuaguggaagaacaagacgcgaacuucgugugucgacgaacguucguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguccacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaagugcagacuaaagauggacaaacugacucuaaaagggaugucauaugugaugugcacaggcuuauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagccaaccccauaguuacugacaaagaaaaaccagucaacauugaggcagaaccgcccuuuggugagaguuacaucauaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuucuuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaaucaauuggaaagguagagaacucaaauguggaagugguauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauuggcugacuuucaaucacaucaacugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauuaggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacauccggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaggcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagcgccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggugaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuucuagcucugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccggagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5854 - RNA, 9879 nt, Artificial Sequence
  derived and/or modified CDS sequence (wt) from DENV-1__GQ199778__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagaggcuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaaucaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccaaucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggaucaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcauugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5855 - RNA, 9879 nt, Artificial Sequence
  derived and/or modified CDS sequence (wt) from DENV-1__GQ199780__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagauaguucaauaugaaaacuugaaauauucaguaauagucaccguucacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaaccuauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaagugcacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaacauaaacacaccagaagggauuaucccagcccucuucgagccggagagagaaaagagugcagcaauagacggggaauauagacugcggggugaagcaaggaaaacguuuguggagcuuaugagaagaggagauuuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguugacugguggagugacgcuguucuuccuaucaggaaggggccuagggaaaacaucuaucggccuacucugcgugauggcuucaagcguacuguuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugauaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauauuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugcgacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacagacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauguaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaacuaucuagauuacaugacaucaaugaagagauucaagaacgagagugauccugaaggggcacucugguga

SEQ ID NO: 5856 - RNA, 9879 nt, Artificial Sequence
  derived and/or modified CDS sequence (wt) from DENV-1__GQ199781__SS-prME
ucugugaccaugcuacuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagaugcacagaacacaaccuucaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugguaauuccaaaaaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguugccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuucuuaaagcaacucugcuagcaguuucagggguguauccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaaaccaaagcaucacaagaagguccccuaccagagauugaagaugagguguuuaggaaaagaaacuuaacaauaauggaccuacauccaggaucggggaaaacaagaagauaucucccagccauaauccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuacugucuccugugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaucaaaaaacaaaaaauaacgauugggacuaugucgucacaacagacaucuccgaaaugggagcaaacuuccgagccgacagggugauagacccaagacggugccugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaagaaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguggacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuugcaccaccugagaaaugugacacacuuuugugugauauuggugaguccucuccaaacccaaccauagaagaaggaagaacguuacgcguccuaaaaaugguggaaccauggcucagagggaaccaauucugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccaugguuacacaaauagccaugacugacacuacacccuuuggacaacagaggguguucaaagagaaaguugacacgcgcacaccaaaagcaagacgaggcacagcacaaaucauggaggugacagccagaugguuaugggguuuucuuuccagaaacaagaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagagaaauaguggugccaugccguaaccaagaugaacuuguggguagggcuagaguaucacaaggugcuggauggagccugagagaaacugcaugccuaggcaagucauaugcacagauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5857 - RNA, 9879 nt, Artificial Sequence
  derived and/or modified CDS sequence (wt) from DENV-1__GQ199782__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcaauggauuugggagaguuaugcgaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacuuuugaagacggaagucacaaacccugccguccugcgcaaacugugcauugaagccaaaauaucaaacaccaccaccgacucaagauguccaacacaaggagaagccacacuuauggaagaacaagacgcgaacuuugugugucgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcccuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauauacagaacaccaccuucaucaucgacggcccaaacaccccagaaugcccugaugaucaaagagcauggaacauuugggaaguugaggacuauggauuuggaauuuucacgacaaauauaugguugagauugcgugacuccuacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggacccauaucucagcacaacuacagaccaggauacuucacacaaacggcagggccauggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacggcauggaaaucagaccaguuaaggaaaaggaagagaaucuagucaaaucaauggucucugcagggucaggggaaguggacagcuucucacuaggacugcuaugcauaucaauaauggucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaauaagaccaauguuugcugucgggcuauuaguccguagacuaacauccagagaaguucuccuucuuacaauuggauugagucuaguggcaucuguggaguuaccaaauuccuuggaggagcugggagauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauucuacuaaguucacuccuuaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaauagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuauuauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggccucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguggcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauauuaugcacuucacagauccucuugaugaggacuacaugggccuugugcgaauccaucacacuggccacuggaccuuugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagagacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacaugaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaggagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcaaaaggaagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcacuaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5858 - RNA, 9879 nt, Artificial Sequence
  derived and/or modified CDS sequence (wt) from DENV-1__GQ199783__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggaaacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggaacgucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugccgacgaacguuuguggauagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagacugauaacagcuaauccuauagucacugacaaagaaaaaccagucaacauugaggcagaaccgccuuuuggugagaguuacaucguaauaggagcaggugaaaaagcuuugaaacuaagcugguucaagaaaggaaguagcauagggaaaauguuugaggcaacugccagaggagcacgaagaauggccauacugggggacaccgcaugggacuuugguucuguaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaaggaagagagcucaaauguggaaguggcaucuuugucaccaaugaaguucacacuuggacagagcaauacaaauuucaagcugacuccccaaagagacuaucagcagccaucgggaaggcaugggaggaggguguguguggaauucgaucauccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaauaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagaaagugaaaagaacgagaccuggaagcuggcaagagccuccuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacagcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacggcauggaaaucagaccaguuaaggaaaaggaagagaaucuagucaaaucaauggucucugcagggucaggggaaguggacagcuucucacugggacugcuaugcauaucaauaaugaucgaagaggugaugagauccagauggaguagaaaaauguugaugacuggaacacuggcuguguuccuccuucuuauaauggggcaauugacauggaaugaucugaucagauuaugcaucaugguuggagccaacgcuuccgacaggauggggaugggaacgacguaccuagcucugauggccacuuuuaaaauaagaccaauguuugcugucgggcuauuauuccguagacuaacauccagagaaguucuccuucuuacaauuggauugagucuaguggcaucuguggaguuaccaaauuccuuggaggagcugggagauggacuugcaauggguauuaugauuuuaaaauuauugacugacuuucagucacaucagcugugggcuaccuugcuguccuugacauuuauuaaaacaacgcuuuccuuacaccaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauaacagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauacuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuucuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaaaccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcccccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacuccuccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgugaguuuaaagaguuugcagcaggaagaagaagcgucucaggugaucuaauauuagaaauagggaagcuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuugggaugcuauucacaggugaauccacugacgcugacggcggcgguauugaugcuaguggcucauuacgccauaauuggaccuggacugcaagcaaaagcuacuagagaagcucaaaaaaggacagcggccggaauaaugaaaaauccaacaguugauggaauuguugcaauagauuuggacccuguggucuaugaugcaaaauuugagaaacaacuaggccaaauaauguuguuaauacuaugcacuucacagauccucuugaugaggaccacaugggccuugugcgaauccaucacacuggccacuggaccucugaccacgcuuugggagggaucuccagggaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaaccagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagagagcuucacaaacagggaaaaugugccacguguguuuacaacaugauggggaagagagagaaaaaacuaggagaguucggaaaggcuaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucugcucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5859 - RNA, 9879 nt, Artificial Sequence
  derived and/or modified CDS sequence (wt) from DENV-1__GQ199784__SS-prME
ucugugacuaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaggggauuauuuucauuuuguuaaugcuaguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguucugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacuaaacuggaaggaaagauaguucaauaugaaaacuugaaauauucaguaauagucaccguccacacuggagaccagcaccaggugggaaaugaaagcacagaacaugggacaacugcaacuauaacaccccaagcucccacgucggaaauacagcugaccgacuacggagcucucacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagacuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagaucuuuggaaccgcauauggaguuuuguucagcgguguuuccuggaccaugaaaauaggauuagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugagguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauuuacagugguuguaggagauguaguugggaucuuggcucaagggaaaaaaaugaucaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacucccacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaauuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucgauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuagccauguuucuuauagcagaaaacaaaaucuggggaaggaaaaguuggccccucaaugaaggaauuauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaacauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacuuauguaccaagggaagagacuagaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucgguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgcgucauucuagcaggaccgaugccaguaacuguagccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggaucaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagugucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcugugcugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacagcuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaauccuuacaugccaagugugguggaaacucuggagcaaaugcaaagaaaacauggaggaaugcuagugcgaaauccacucucaagaaauucuacucaugaaauguauuggguuucauguggaacaggaaacauugugucagcaguaaacaugacaucuagaauguuacuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguagugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccagaauuacugacaucauggagcccgaacaugcccuacuggcuacgucaaucuuuaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugaaggaaucuuuuuacccagcgaauuggagacccaaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggcuuccaacauacaaguggccauaaaccaagugagaagacuaauugggaaugagaauuaucuagauuacaugacaucaaugaagagauucaagaacgagggugaucccgaaggggcacucugguga

SEQ ID NO: 5860 - RNA, 9879 nt, Artificial Sequence
  derived and/or modified CDS sequence (wt) from DENV-1__GQ199785__SS-prME
ucugugaccaugcuccuuaugcugaugccuacagccuuggcauuccauuugacuacacgaggaggagagccgcacaugauaguuagcaagcaggaaagaggaaagucacuuuuguucaagaccucagcagguguuaacaugugcacccucauagcgauggauuugggagaguuaugugaggacacaaugacuuacaaauguccucgaauuacugagguggaaccagaugacguugauuguuggugcaacaccacagacacaugggugaccuauggaacauguucccaaacuggcgagcaccgacgagacaagcguuccgucgcacuggccccacacgugggacuugguuuagaaacaagagccgaaacguggauguccucugaaggcgcuuggaaacagauacaaaaaguggagacuugggcucugagacacccaggauucacggugauagcccuuuuucuagcacaugccauaggaacauccaucacccagaaagggauuauuuucauucuguuaaugcuggugacaccuuccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacauugguggaagaacaagacgcgaacuuugugugccgacgaacguucguggacagaggcuggggcaauggcugugggcucuucggaaaaggaagccugauaacgugugcuaaguucaagugugugacaaaacuggaaggaaagauaguucaauaugaaaauuugaaauauucaguaauagucaccguccacacuggagaccagcaccaggugggaaaugagagcacagaacaugggacaacugcaacuauaacaccucaagcuccuacgucggaaauacagcugaccgacuacggagcucuuacauuggacugcucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacguccggaacgacaacaauuuuugcaggacaccugaaauguagacuaaagauggacaaacugacucuaaaagggaugucauaugugaugugcacagguucauucaagcuagagaaagaaguggcugagacccagcauggaaccguuuuagugcagauuaaauacgaaggaacagaugcaccaugcaagaucccuuuuucgacccaagaugaaaaaggaguaacccagaacgggagauugauaacagcuaaccccauagucacugacaaagaaaaaccagucaacauugaggcagaaccgccuuuuggugagaguuacaucgugauaggagcaggcgaaaaagcuuugaaacuaagcugguucaagaaaggaagcagcauagggaaaauguuugaggcaacugccagaggagcacgaaggauggccauauugggagauaccgcaugggacuuugguucuauaggaggaguguucacgucuguuggaaaacuaguacaccagauuuuuggaacugcauauggaguuuuguucagcgguguuuccuggaccaugaagauaggaauagggguucugcugacauggcuaggauuaaacucaaggagcacgucccuuucgaugacgugcauugcaguuggucuaguaacacuauaccuaggagucaugguucaggcggauucaggaugugugauuaauuggaaggguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacccgucucgagaauaucauguggaggcaaauaucaaaugaacugaaccacaucuuacuugaaaaugacaugaaauucacaguaguuguaggagauguuguugggaucuuggcucaaggaaaaaagaugauuaggccacaacccauggaacacaaauacucguggaaaagcuggggaaaagcuaaaaucauaggggcagauguacagaacaccaccuucaucaucgauggcccaaacaccccagaaugcccugaugaucaaagagcauggaacauuugggaaguugaggacuauggauuuggaauuuucacgacaaacauauggcugaaauugcgugacuccuacacccaagugugugaccaccggcuaaugucagcugccaucaaggacagcaaggcaguucacgcugauaugggguacuggauagaaagugaaaagaaugagaccuggaagcuggcaagagccucuuuuauagaaguuaaaacauguaucuggccaaaaucccacacccuauggagcaauggaguucuggaaagugaaaugauaauuccaaaaaucuauggaggaccaauaucucagcacaacuacagaccaggauauuucacacaaacggcagggccguggcaccuaggcaaguuggaacuggauuuugauuuaugugaggguaccacaguuguuguggaugaacauuguggaaaucgaggaccaucucuuagaaccacaacagucacaggaaagauaauucaugaaugguguugcagaucuugcacgcuaccacccuuacguuucaaaggagaagauggguguugguacgguauggaaaucagaccagucaaggaaaaggaagagaaucuagucaaaucaauggucucagcagggucaggggaaguggacagcuuuucacuaggacuguuaugcauaucaauaaugaucgaagaggugaugagauccagauggaguagaaaaaugcugaugacuggaacacuggcuguguucuuccuucucauaaugggacaauugacauggaaugaucugaucaggucaugcaucaugguuggagccaacgcuuccgacaggauggggaugggaacgacguaucuagcuuugauggccacuuuuaaaaugagaccaauguuugcugucgggcuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucagucauaucagcugugggcuaccuugcuguccuugacauuuaucaaaacaacguuuuccuugcacuaugcauggaagacaauggcuaugguacugucaauuguaucucuccuccccuuaugccuguccacgaccucccaaaaaacaacauggcucccggugcuauugggaucucuuggaugcaaaccacuaaccauguuucuaauagcagaaaacaaaaucuggggaaggaaaaguuggccccucaaugaaggaaucauggcuguuggcauagucagcauccuacuaaguucacuccucaaaaaugaugugccgcuagcugggccacuaauagcuggaggcaugcuaauagcauguuauguuauaucaggaagcucagccgaccuaucacuagagaaagcggcugaggucucuugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccagggaaaaaccccaaaaauguacaaacagcgccgggcaccuucaagaccccugaaggugaaguuggagccauugccuuagauuucaaacccggcacaucuggaucuccuaucgugaacagagaagggaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucgggaaaaacaagaagauaucuuccagccauaguccgugaggccauaaaaaggaagcugcgcacacuaauuuuggcucccacaaggguugucgcuuccgaaauggcagaggcgcucaaggggaugccaauaagguaccaaacaacagcagugaagagugaacacacaggaagagagauaguugaucuuaugugucacgccacuuucaccaugcgucuccugucuccugugagaguucccaauuacaacaugauuaucauggaugaagcacauuucaccgauccauccagcauagcggccagaggauacaucucaacccgagugggcaugggugaagcagcugcgaucuucaugacagccacucccccaggaucgguggaagccuuuccacagagcaaugcaguuauccaagaugaagaaagagacauuccugaaagaucauggaacucaggcuaugaguggaucacugacuucccagguaaaacaguuugguuuguuccaagcaucaaaucaggaaaugacauugccaacugccuaagaaagaaugggaaacgggugauucaauugagcaggaaaaccuuugauacagaguaccaaaaaacaaaaaauaacgacugggacuacgucguuacaacagacaucuccgaaaugggagcaaacuuccgggcugacagggugauagacccaagacggugucugaaaccgguaauacuaaaagaugguccagagcgugucaucuuagcaggaccgaugccagugacuguggccagugccgcccagaggagaggaagaauuggaaggaaccacaauaaggaaggugaucaguacaucuacaugggacagcccuuaaacaacgaugaagaucacgcccacuggacagaagcaaaaaugcuccuugauaauauaaacacaccagaagggauuaucccagcccucuucgaaccggagagagaaaagagugcagcaauagacggggaauacagacugcggggugaagcaaggaaaacguuuguggagcucaugagaagaggagaucuaccugucugguuauccuacaaagucgccucagaaggcuuccaguacuccgacagaagauggugcuuugacggggaaaggaacaaccagguguuggaggagaacauggacguggagaucuggacaaaagaaggagaaagaaagaaacuacgaccccgcuggcuagaugccagaacauacucagacccacuggcccugcgcgaguuuaaagaguuugcagcaggaagaagaagcgucucaggugauuuaauacuagaaauagggaaacuuccacaacacuugacgcaaagggcccagaaugcuuuggacaaccuggucauguugcacaacuccgaacaaggaggaagagccuauagacaugcaauggaagaacugccagacacuauagaaacguugaugcuccuagcuuugauagcuguguugacugguggagugacgcuguucuuccuaucaggaaagggccuagggaaaacaucuaucggccuacucugcgugauggcuucaagcgcacugcuauggauggccaguguggagccccauuggauagcggccuccaucauacuggaguucuucuugauggugcugcuuauuccagagccagacagacaacgcacuccgcaagacaaccagcuggcauauguggugauagguuuguuauuuaugauacuuacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagccauauugaugggacuugacaaaggauggccaauaucgaagauggacauaggaguuccacuucuagccuuggggugcuauucccaagugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauucuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacaccuacaaaaggagugggauaauggaaguggacagauccgaagccaaagagggacuaagaagaggagaaacaaccaaacaugcagugucgagaggaaccgccaaacugaggugguuuguggagaggaaucuugugaaaccagaagggaaagucauagaccucgguuguggaagagguggcuggucauacuauugcgcugggcugaagaaagucacagaagugaagggauacacaaaaggaggacccggacaugaggaaccaaucccaauggcgaccuauggauggaaccuaguaaagcugcacuccgggaaagacguauucuuuauaccaccugagaaaugugacacccuuuugugugauauuggugaauccucuccaaacccaacuauagaggaaggaagaacguuacgcguccuaaagaugguggaaccauggcucagaggaaaccaauucugcauaaagauucugaaucccuacaugccaagugugguggaaacccuggaacaaaugcaaagaaaacauggaggaaugcuagugcgaaauccacuuucaagaaauucuacccaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacaagacauguggcaguggaaccagagguagccaaucuggauaucauuggccagaggauagagaacauaaaacaugaacacaagucaacauggcauuaugaugaggacaauccauauaaaacaugggccuaucauggaucauaugaggucaagccaucaggaucagccucauccaugguuaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacugcacaaaucauggaggugacagccaagugguuauggggcuuucuuuccagaaacaaaaaaccaagaauuuguacaagagaggaguucacaagaaaaguuaggucaaacgcagccauuggggcaguguucguugaugaaaaucaauggaacucagcaaaagaagcgguggaagaugaacgguucugggaccuugugcacagagagagggagcuucacaaacagggaaaaugcgccacguguguuuacaacaugauggggaagagagagaaaaagcuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacucggauacauacucagagacauaucaaagauuccugggggaaauauguaugcagaugacacagcuggaugggauacaaggauaacagaggaugaccuucagaaugaggccaaaauuacugacaucaugaagccugaacaugcccuacuggcuacgucaaucuucaagcugaccuaccaaaauaaggugguaaggguacagagaccagcaagaaauggaaccgugauggaugucauauccagacgugaccagagaggaaguggccaggucggaacuuauggcuuaaacacuuucaccaacauggaagcccagcuuauaagacaaauggagucugagggaaucuuuucacccagcgaguuggagaccccaaauuuagccgagagaguucucgacuggcuggaaaaacauggcgucgaaaggcuaaaaagaauggcaaucagcggagaugacugcguggugaaaccaauugaugacagguuugcaacagccuuaucagcucugaaugauaugggaaaaguaagaaaagauauaccacaaugggaacccucaaaaggauggaaugauuggcaacaagugccuuuuuguucacaccacuuccaccagcugauuaugaaggauggaagggaaauaguggugccaugccgcaaccaagaugaacuuguggguagggcuagaguaucacaaggugcuggauggagccugagagaaacugcaugccuaggcaagucauaugcacaaauguggcaacugauguacuuccacaggagagaccugagacuagccgcuaaugcuaucuguucagccguuccaguugauugggucccaaccagccguaccaccuggucgauccaugcccaucaccaauggaugacaacagaagacauguugucaguguggaauaggguuuggauagaggaaaacccauggauggaggacaaaacccauauauccagcuggggagauguuccauauuuaggaaaaagggaagaucagugguguggaucccugauaggcuuaacagcaagggccaccugggccaccaacauacaaguggccauaaaccaagugagaagacuaauugggaaugagaauuauuuagauuacaugacaucaaugaagagauucaagaacgagagugauccugaaggggcacucugguga

SEQ ID NO: 5861 - RNA, 9879 nt, Artificial Sequence
  derived and/or modified CDS sequence (wt) from DENV-1__GQ199786__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgccuggaaacagauacaaagaguggagacuugggccuugagacacccaggauucacggugauagcucuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugagaacuugaaauauucaguaauagucaccguucacaccggagaccagcaccaagugggaaaugaaagcacagaacaugggacaacugcaaccauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagaucugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggacuaaacucaaggagcacgucccuuucgaugacgugcauugcaguuggccuaguaacacuauaccuaggagucaugguucaggcggauucaggauguguaauaaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaaacagcagggccguggcaccuaggcaaguuggaacuggauuuugauuugugugaggguaccacaguuguuguggaugaacauuguggaaaucgaggaccaucucuuaggaccacaacagucacagggaagauaauucaugaaugguguugcagaucuugcacgcuaccacccuuacguuucagaggagaagaugggugcugguaugguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaaaaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguuugcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugauuuucaaucacaucagcugugggccaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccgguguuauugggaucccuuggaugcaaaccacuaaccauguuucuuauagcagaaaacaaaaucuggggaaggagaaguuggccucucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggccgaggucuccugggaagaagaagcagaacacucuggcgccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauucuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuuuaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauccaauugagcaggaaaaccuuugauacagaguaccaaaaaacaaaaaacaacgacugggacuacgucgucacaacagacaucucagaaaugggagcaaauuuccgagccgacagggugauagacccaagacggugucugaaaccgguaauacuaaaagaugguccagagcgugucauuuuagcaggaccaaugccagugacuguggccagugccgcccagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagccuugauagcuguguuaacugguggagugauacuguucuuccuaucaggaaggggccuagggaaaacaucuauuggccuacucugcguaauggcuucaagcguacugcuauggauggccaguguggagccccauuggauagcggccuccaucauacuggaguucuucuugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcccauuaugccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagaaggauugaaaagaggagaaacaaccaaacaugcagugucgagaggaaccgcuaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaagcugcacucugggaaagacguauucuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaggucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcaggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5862 - RNA, 9879 nt, Artificial Sequence
  derived and/or modified CDS sequence (wt) from DENV-1__GQ199787__SS-prME
ucugugaccaugcugcucaugcuggugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugauguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcucccacgucggaaauacagcugaccgacuacggagcucuuacauuggauugcucacccagaacaggacuagacuuuaaugaaaugguguuguugacaaugaaagaaaagucauggcuaguccauaaacaaugguuucuagaccuaccacugccuuggaccucaggagcuucaacaucacaagagacuuggaacagacaagauuugcuggugacauuuaagacagcucaugcaaagaagcaggaaguagucguacuaggaucacaagaaggagcaaugcacaccgcguugaccggagcgacagaaauccaaacgucuggaacgacaacaaucuuugcaggacaccugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaauccagaaugggagauugauaacagcaaauccuauagucacugacaaagaaaaaccagucaacauugaggcagaaccgccuuuuggugagaguuacaucgugauaggaguaggugaaaaagcuuugaaacugagcugguucaagaaaggaaguagcauagggaaaauguuugaggcaacugccagaggagcacgaagaauggccauacugggggacaccgcaugggacuuugguucuauaggaggaguguucacaucuguuggaaaacuagugcaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagaugugcagaacacaaccuuuaucaucgacggcccaaacaccccagaaugcccugaugaucaaagagcauggaacauuugggaaguugaggacuauggauuuggaauuuucacgacaaauauaugguugaaauugcgugacuccuacacucaagcgugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaauggaguucuggagagugaaaugguaauuccaaaaaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguuguagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacauuggcuguguuccuccuucucauaauggggcaauugacauggaaugaucugaucagauuaugcauuaugguuggagccaacgcuuccgacaggauggggaugggaacgacguaccuagcucugauggccacuuuuaagaugagaccaauguuugcugucgggcuauuauuccguagacuaacauccagagaaguucuccuucuuacaauuggauugagucuaguggcaucuguggaguuaccaaauuccuuggaagagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagcugacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuacuuaaagcaacucugcuagcaguuucagggguguauccauuaucaauaccagcgacccuuuuuuugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccagaggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagguccccuaccagagauugaagaugagguguuuaggaaaagaaacuuaacaauaauggaccuacauccaggaucggggaagacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacucgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccuguuuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugcuuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggcuuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaggcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucuaaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacacuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaacuuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaagaaaccaagaauuuguacaagagaggaguucacaaggaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaacauggcgucgaaaggcugaaaagaauggcaaucagcggggaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaacgaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguguccaguuggggagauguuccauaucuaggaaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaaugagggugaucccgaaggggcacucugguga

SEQ ID NO: 5863 - RNA, 9879 nt, Artificial Sequence
  derived and/or modified CDS sequence (wt) from DENV-1__GQ199788__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguuuagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcgacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggccaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuguuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguucuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguagagguccaagaugauggaaccaugaagauaaaggaugaagagagagaugacacgcuaaccauucuccuuaaagcaacucugcuagcagucucagggguauacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuugacaauaauggaccuacauccaggaucggggaaaacaagaagauaucuuccagccauaguccgugaggccauaaaaaggaagcugcgcacauuaauucuggcucccacaagaguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguauaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacguacucagacccacuggcccugcgcgaguuuaaagaguuugcagcaggaagaagaagcgucucaggugaucuaauauuagaaauagggaaacuuccacaacaccugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuagggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccaggagaguucuugacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccaguugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaacgcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggugcacucugguga

SEQ ID NO: 5864 - RNA, 9879 nt, Artificial Sequence
  derived and/or modified CDS sequence (wt) from DENV-1__GQ199789__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaaaaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaauugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguccaacaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaggaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggacgucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaacaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuccuucuaacaauuggauugagucuaguggcaucuguggaguuaccaaacuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguaggaguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguucgugaggccauaaaaaggaagcugcgcacauuaauucuggcucccacaaggguugucgcuuccgaaauggcagaggcgcucaagggaaugccaauaagguaccaaacaacagcagugaagggugaacacacaggaaaagagauaguugaccucaugugucacgccacuuucaccaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacguugaugcuccuagcuuugauagcuguguuaacugguggagugacgcuguucuuccuaucaggaaggggccuagggaaaacaucuaucggccuacucugcgugauggcuucaagcgcacugcuauggauggccaguguggagccccauuggauagcggccuccaucauauuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagauuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugguacuaugcacaucacaaauccucuugaugcggacuacaugggccuugugugaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauagaagcccagcugauaagacagauggagucugaggaaauuuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgccaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaucaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugauccugaaggggcacucugguga

SEQ ID NO: 5865 - RNA, 9879 nt, Artificial Sequence
  derived and/or modified CDS sequence (wt) from DENV-1__GQ199790__SS-prME
ucugugacuaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugucauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguucugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacuaaacuggaaggaaagauaguucaauaugaaaacuugaaauauucaguaauagucaccguccacacuggagaccagcaccaggugggaaaugaaagcacagaacaugggacaacugcaacuauaacaccccaagcucccacgucggaaauacagcugaccgacuacggagcucucacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaagacuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacccuaaaagggaugucauaugugaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagaucuuuggaaccgcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugagguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauuuacagugguuguaggagauguaguugggaucuuggcucaagggaaaaaaaugaucaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacucccacacccaagugugugaccaccggcuaaugucagcugccaucaaggacagcaaggcaguucaugcugacaugggguacuggauagaaagugaaaagaacgagaccuggaagcuggcaagagccucuuucauagaaguuaaaacaugcauuuggccaaaaucccacacucuauggagcaacggaguucuggaaagugaaaugauaauuccaaagaucuauggaggaccaauaucucagcacaauuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucgauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuagccauguuucuuauagcagaaaacaaaaucuggggaaggaaaaguuggccccucaaugaaggaauuauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucacacaacauauuaguggagguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacuuauguaccaagggaagagacuagaaccgaguugggccagugucaaaaaagaccugaucucauauggaggagguuggaggcuucaaggaucuuggaacacgggagaagaagugcaggugauugcuguugaaccaggaaaaaaccccaaaaauguacaaacagcgccaggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucgguggaggccuuuccacagagcaaugcaguuauccaagaugaggaaagagacauuccugagagaucauggaacucaggauaugaguggaucacugacuucccagguaaaacaguuugguuuguuccaagcaucaaaucaggaaaugacauugccaacugcuuaagaaagaaugggaaacggguaauucaauugagcagaaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacuaaaagaugguccagagcgcgucauucuagcaggaccgaugccaguaacuguagccagugccgcccagaggagaggaagaauuggaaggaaccacaauaaggaaggugaucaguacaucuacaugggacagccuuuaaacaacgacgaagaucacgcucacuggacagaagcaaaaaugcuccuugauaauauaaacacaccagaagggaucaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagugucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcugugcugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacagcuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucgguuguggaagagguggcuggucauacuauugcgcugggcugaagaaagucacagaagugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaauccuuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguuacuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucauggaucauaugaggucaagccaucaggaucagccucauccauggucaauggcguagugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagauauaucaaagauuccagggggaaauauguaugcagaugacacagccggaugggauacaaggauaacagaggaugaucuucagaaugaggccagaauuacugacaucauggagcccgaacaugcccuacuggcuacgucaaucuuuaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugaaggaaucuuuuuacccagcgaauuggagacccaaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggcuuccaacauacaaguggccauaaaccaagugagaagacuaauugggaaugagaauuaucuagauuacaugacaucaaugaagagauucaagaacgagggugaucccgaaggggcacucugguga

SEQ ID NO: 5866 - RNA, 9879 nt, Artificial Sequence
  derived and/or modified CDS sequence (wt) from DENV-1__GQ199791__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggugagcaccgacgagacaaacguuccgucgcacuggccccacacgugggacuugguuuggaaacaagaaccgaaacguggauguccucugaaggcgcuuggaaacagauacaaagaguggaaacuugggcccugagacacccaggauucacggugauagcccuuuuucuagcacaugccauaggaacauccaucacccagaaggggauuauuuucauuuuguuaaugcugguaacaccauccauggccaugcgaugcgugggaauaggcagcagggacuucguggaaggacugucaggagcaacuuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaauggcugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaaccgcaacuauaacaccucaagcucccacaucggaaauacagcugaccgacuacggagcucuuacauuggauugcucacccagaacaggacuagacuuuaaugaaaugguguuguugacaaugaaagaaaaaucauggcuaguccauaaacaaugguuucuagaccuaccacugccuuggaccucaggagcuucaacaucacaagagacuuggaacagacaggauuugcuggugacauucaagacagcucaugcaaagaagcaggaaguagucguacuaggaucacaagaaggagcaaugcacacugcguugaccggagcgacagaaauccaaacgucuggaacgacaacaaucuuugcaggacaucugaaauguagauuaaagauggacaaacugacucuaaaagggaugucauaugugaugugcacaggcucauucaagcuagagaaagaaguggcugagacccagcauggaaccguuuuagugcagauuaaauacgaaggaacagaugcaccaugcaagaucccuuuuuugacccaagaugaaaaaggaguaacccagaaugggagauugauaacagcuaauccuauagucacugacaaagaaaaaccagucaacauugaggcagaaccgccuuuuggugagaguuacaucgugauaggagcaggugaaaaagcuuugaaacuaagcugguucaagaaaggaaguagcauagggaaaauguuugaggcaacugccagaggagcacgaagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaguguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaaacaaauaucaaaugaacugaaccacaucuuacuugaaaaugacaugaaauucacagugguuguaggagauguagucgggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaagugugugaccaccggcuaaugucagcugccaucaaggacagcaaggcaguucaugcugacaugggguacuggauagagagugaaaagaacgagaccuggaagcuggcaagagccucuuucauagaaguuaaaacaugcauuuggccaaaaucccacacucuauggagcaauggaguucuggaaagugaaaugauaauuccaaagaucuauggaggaccaauaucucagcacaacuacagaccaggauauuucacacaaacggcagggccguggcaccuagguaaguuggaacuggauuuugauuugugugaggguaccacaguuguuguggaugaacauuguggaaaucgaggaccaucucuuagaaccacaacagucacaggaaagauaauucaugaaugguguugcagaucuugcacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcugucgggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaaaccacuaaccauguuucuuauagcagaaaacaaaaucuggggaaggaaaaguuggccccucaaugaaggaaucauggcuguuggaguagucagcauccuacuaaguucacuccucaaaaaugaugugccgcuagcugggccacuaauagcuggaggcaugcuaauagcauguuauguuauaucuggaagcucagccgacuuaucacuagagaaagcggcugaggucuccugggaagaagaagcagaacacucuggugccucgcacaauauauuaguggagguccaagaugauggaacuaugaagauaaaggaugaagagagagaugacacgcuaaccauucuccuuaaagcaacucugcuggcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacacgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcugcguacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacccgagugggcaugggugaagcagcugcgaucuucaugacagccacucccccaggaucaguggaggccuuuccacagagcaaugcaguuauccaagaugaggaaagagacauuccugagagaucauggaacucaggauaugaguggaucacugacuucccagguaaaacaguuugguuuguuccaaguaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagccgacagggugauagacccaagacggugucugaaaccgguaauacugaaagauggcccagagcgugucauucuagcaggaccgaugccaguaacuguggccagugccgcccagaggagaggaagaauuggaaggaaccacaauaaggaaggugaucaguacaucuacaugggacagccuuuaaacaacgacgaagaucacgcucacuggacagaagcaaaaaugcuccuugacaauauaaacacaccagaagggauuaucccagcccucuucgagccagagagggaaaagagugcagcaauagacggggaauacagacugcggggugaagcaaggaagacguuuguggagcucaugagaagaggagaucuaccugucuggcuauccuacaaaguugccucagaaggcuuccaguacucugauagaagauggugcuucgacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauuaccagacaccauagaaacguugaugcuccuagcuuugauagcuguguugacugguggagugacgcuguucuuccuaucaggaaggggccuagggaaaacaucuaucggcguacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuuacauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccaucacacuggccacuggaccucugaccacgcuuugggagggaucuccaggaaaauuuuggaacaccacgauagcgguuuccauggcaaauauuuucagaggaaguuaucuagcaggagcaggucuggccuucucauuaaugaaaucuuuaggaggagguaggagaggcacgggagcccaaggagaaacacugggagagaaauggaaaaggcagcugaaccaacugagcaagucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaggugaagggauauacaaaaggaggaccuggacaugaggaaccaaucccaauggcgaccuauggauggaaccuaguaaaacugcacuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcauuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuuccagaaacaaaaaaccaagaaucuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuccacaaacagggaaaaugugccacguguguuuacaacaugauggggaagagagagaaaaagcuaggagaguucggaaaggcaaaagggagucgugcaauaugguacaugugguugggagcacguuuucuagaguucgaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguacagagaccagcaaaaaauggaaccgugauggaugucauauccagacgugaccaaagaggaaguggccaggucggaacuuauggcuuaaacacuuucaccaacauggaagcccagcuaauaagacaaauggagucugagggaaucuuuuuacccagcgaauuggagaccccaaauuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuccacaggagagaucugagacuagccgcuaaugcuaucuguucagccguuccaguugauugggucccaaccagucgcaccaccuggucgauccaugcccaccaccaauggaugacaacagaagacauguugucaguguggaacaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacagguggccauaaaccaagugagaagacuaauugggaaugagaauuaucuagauuacaugacaucaaugaagagauucaagaacgagggugaucccgaaggggcauucugguga

SEQ ID NO: 5867 - RNA, 9879 nt, Artificial Sequence
  derived and/or modified CDS sequence (wt) from DENV-1__GQ199792__SS-prME
ucugugaccaugcuccuuaugcugaugccuacagccuuggcguuccauuugacuacacgagggggagagccgcacaugauagucagcaagcaggaaagaggaaagucacuuuuguucaagaccucagcaggugucaacaugugcacccuuauagcgauggauuugggagaguuaugugaggacacaaugacuuacaaaugcccucgaauuacugaggcggaaccagaugacguugauuguuggugcaaugccacagacgcaugggugaccuauggaacauguucccaaacuggcgagcaccgacgagacaaacguuccgucgcacuggccccacacgugggacuuggcuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcuuuucggaaaaggaagccuaauaacgugugcuaaguuuaagugugugacaaaacuggaaggaaaaauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacaugggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucaccgacuucccaggcaaaacaguuugguuuguuccaagcauuaaaucaggaaaugacauugccaacugccuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacgggagcccaaggggaaacacugggagaaaaauggaaaagacagcugaaccaacugagcaagucagaauucaacaccuauaaaaggagugggauuauggaaguggacagauccgaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauccugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggacgucauccccauggucacacaaauagccaugacugacacuacacccuuugggcaacagaggguguuuaaagagaaaguugacacacgcacaccaaaagcaaaacgaggcacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaggugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaccaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugauccugaaggggcacucugguga

SEQ ID NO: 5868 - RNA, 9879 nt, Artificial Sequence
  derived and/or modified CDS sequence (wt) from DENV-1__GQ199793__SS-prME
ucugugaccaugcuucuuaugcugaugcccacagccuuggcguuccaucugacuacacgagggggagagccgcauaugauaguuaccaagcaggaaagaggaaagucacuuuuguuuaagaccucagcaggcgucaacaugugcacccuuauagcgauggauuugggagaguuaugugaggacacaaugacuuacaaaugcccucggaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggugcuuggaaacagauacaaagaguggagacuugggcccugagacacccaggauucacggugauagcccuuuuuuuagcacaugccauaggaacauccaucacccagaaggggauuauuuucauuuuguuaaugcugguaacaccauccauggccaugcgaugcgugggaauaggcagcagggacuucguggaaggacugucaggagcaaccuggguagacgugguacuggaacauggaagcugcgucaccaccauggcgaaagacaaaccaacauuggacauugaacucuugaagacggaagucacaaacccugccguccugcgcaaacugugcauugaagcuaaaauaucaaacaccaccaccgacucaagauguccaacacaaggagaagccacacuuauggaagaacaagacgcgaacuuugugugucgacgaacguuuguggacagaggcuggggcaaugguugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacacgggacaacugcaacuauaacaccucaagcucccacgucggaaauacagcugaccgacuacggagcucuuacauuggacugcucacccagaacaggacuagacuuuaaugaaaugguguuguugacaaugaaagaaaaaucauggcuaguccacaaacaaugguuucuagaccuaccacugccuuggacuucaggagcuacaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaaucuuugcaggacaccugaaauguagauuaaagauggacaaacugacucuaaaagggaugucauauguaaugugcacaggcucauucaagcuagagaaagaaguggcugagacccagcauggaaccguuuuagugcagauuaaauacgaaggaacagaugcaccaugcaagaucccuuuuucgacccaagaugaaaaaggaguaacccagaaugggagauugauaacagcuaauccuauagucacugacaaagaaaaaccagucaacauugaggcagaaccaccuuuuggugagaguuacaucgugauaggagcaggugaaaaagcuuugaaacuaagcugguucaagaaaggaaguagcauagggaaaauguuugaggcaacugccagaggagcacggagaauggccauacugggggacaccgcaugggacuuugguucuauaggaggaguguucacaucuguuggaaaacuaguacaccagauuuuuggaacugcauauggaguuuuguucagcgguguuuccuggaccaugaaaauaggaauagggguucugcugacauggcuaggauuaaacucaaggagcacgucccuuucaaugacgugcauugcaguuggccuaguaacacuauaccuaggagucaugguucaggcggauucaggauguguaauuaauuggaaagguagagagcucaaauguggaaguggcauuuuugucaccaaugaaguucacacuuggacagagcaauacaaauuucaagcugacuccccaaagagacuaucagcagccaucgggaaggcaugggaggaggguguguguggaauucgaucagccacucgucucgagaauaucauguggaagcaaauaucaaaugaacugaaccacaucuuacuugaaaaugacaugaaauucacagugguuguaggagauguaguugggaucuuggcucaaggaaaaaaaaugauuaggccacaacccauggaacacaaauacucguggaaaagcuggggaaaagcuaaaaucauaggggcagauguacagaacaccaccuucaucaucgacggcccaaacaccccagaaugcccugaugaucaaagagcauggaacauuugggaaguugaggacuauggauuuggaauuuucacgacaaauauaugguugaaauugcgugacuccuacacccaaaugugugaccaccggcuaaugucagcugccaucaaggacagcaaggcaguucaugcugacaugggguacuggauagaaagugaaaagaacgagaccuggaagcuggcaagagccucuuucauagaaguuaaaacauguauuuggccaaaaucccacacucuauggagcaacggaguucuggaaagugaaaugauaauuccaaagaucuauggaggaccaauaucucagcacaacuacagaccaggauauuucacacaaacggcagggccauggcaccuagguaaguuggaacuggauuuugauuugugugaggguaccacaguuguuguggaugaacauuguggaaaccgaggaccaucucuuagaaccacaacagucacaggaaagauaauucaugaaugguguugcagaucuuguacgcuaccacccuuacguuuuaaaggagaggauggguguugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaauguugaugacuggaacacuggcuguguuccuccuucucauaauggggcaauugacauggaaugaucugaucagauuaugcaucaugguuggagccaacgcuuccgacaggauggggaugggaacgacguaccuagcucugauggccacuuuuaaaaugagaccaauguuugcuguugggcuauuauuccguagacuaacauccagagaaguucuccuucuuacaauuggauugagucuaguggcaucuguggaguuaccaaauuccuuggaggagcugggggauggacuugcaaugggcauuaugauuuuaaaauuauugacugacuuucagucacaucagcugugggcuaccuugcuguccuugacauuuauuaaaacaacgcuuuccuuacacuaugcauggaagacaauggcuaugguacugucaauuguaucucucuuccccuuaugccuguccacgaccucccaaaaaacaacguggcuuccggugcuauugggaucucuuggaugcaagccacuaaccauguuucucauaacagaaaacaaaaucuggggaaggaaaaguuggccccucaaugaaggaaucauggcuguuggaguggucaguauccuacuaaguucacuccucaaaaaugaugugccgcuagcugggccacuaauagcuggaggcaugcuaauagcauguuaugucauaucuggaagcucagccgacuuaucacuagagaaagcggcugaggucuccugggaagaagaagcagaacacucuggugccucacacaauauauuaguggaaguccaagaugauggaacuaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggagugcuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgaguugggccagugucaaaaaagaccugaucucauauggaggagguuggaggcuucaaggauccuggaacgcgggagaagaagugcaggugauugcuguugaaccaggaaaaaaccccaaaaauguacaaacagcgccgggcaccuucaagaccccugaaggugaaguuggagccauugcccuagauuuuaaacccggcacaucuggaucucccaucgugaacagagaaggaaaaauaguaggucuuuauggaaauggaguggugacaacaaguggaaccuacgucagugccauagcucaagccaaagcaucacaagaagggccccuaccagagauugaagaugagguguuuaggaaaagaaacuuaacaauaauggaccuacauccaggaucggggaaaacaagaagauaucucccagccauaguccgugaggccauaaaaaggaagcuacgcacacuaauuuuggcucccacaaggguugucgcuuccgaaauggcagaggcgcucaagggaaugccaauaagguaccaaacaacagcagugaagagugaacacacaggaaaagagauaguugaccucaugugccacgccacuuucaccaugcgucuccugucucccgugagaguucccaauuacaacaugauuaucauggaugaagcacauuucaccgauccauccaguauagcagccagaggguacaucucaacucgagugggcaugggugaagcagcugcgaucuucaugacagccacucccccaggaucaguggaggccuuuccacagagcaaugcaguuauccaagaugaggaaagagacauuccugagagaucauggaacucaggacaugaguggaucacugacuucccagguaaaacaguuugguuuguuccaagcaucaaaucaggaaaugacauugccaacugcuuaagaaagaaugggaaacggguaauucaauugagcaggaaaaccuuugauacagaguaccaaaaaacaaaaaauaacgauugggacuaugucgucacaacagacaucuccgaaaugggagcaaacuuccgagcugacagggugauagacccaagacggugucugaaaccgguaauacuaaaagaugguccagagcgugucauucuagcaggaccgaugccaguaacuguggccagugccgcccagaggagaggaagaauuggaaggaaccacaauaaggaaggugaucaguacaucuacaugggacagccucuaaacaacgacgaagaucacgcucacuggacagaagcaaaaaugcuccuugauaauauaaacacaccagaagggauuaucccagcucucuucgagccagagagggaaaagagugcagcaauagacggggaauacagacugcggggugaagcaaggaagacguuuguggagcucaugagaaggggagaucuaccugucuggcuauccuacaaaguugccucagaaggcuuccaguacucugauagaagauggugcuucgacggggaaaggaacaaucagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaccuggucauguugcacaacuccgaacaaggaggaagagccuauagacaugcaauggaagaauugccagacaccauagaaacguugaugcuccuagcuuugauagcuguguugacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccuaauggugcugcuuauuccagagccagacagacaacgcacuccgcaggacaaucagcuggcauauguggugauagguuuguuauucaugauacugacaguagcagccaaugagaugggacuacuggaaaccacaaagaaagacuuagggauuggccauguggcuguugaaaaucaccaccaugccacaaugcuggacguagacuugcauccagcuucagccuggacccucuaugcaguggccacaacaauuaucacucccaugaugaggcacacaaucgaaaacacaacggcaaacauuucccugacagcuauugcaaaccaggcagcuauauugaugggacuugacaaaggauggccaauaucgaagauggacauaggaguuccacuucucgccuuggggugcuauucacaggugaauccacugacgcugacagcggcgguauugaugcuaguggcucauuacgccauaauuggaccuggacuacaagcaaaagcuacuagagaagcucaaaaaaggacagcggccggaauaaugaaaaauccaaccguugauggaauuguugcaauagauuuggacccuguggucuaugaugcaaaauuugagaaacaacuaggccaaauaauguuguuaauacuaugcacuucacagauccucuugaugaggacuacaugggccuugugcgaauccauuacacuggccacuggaccucugaccacgcuuugggagggaucuccaggaaaauuuuggaacaccacgauagcgguuuccauggcaaacaucuucagaggaaguuaucuagcaggagcaggucuggccuucucauuaaugaaaucuuuaggaggagguaggagaggcacgggagcccaaggggaaacacugggagagaaauggaaaaggcagcugaaccaacugagcaaaucagaauucaacauuuacaaaaggagugggauaauggaaguggacagauccgaagccaaagagggacugaaaagaggagaaacaaccagacaugcagugucgagaggaaccgccaaacugaggugguuuguggagaggaaccuugugaaaccagaagggaaagucauagaccucggcuguggaagagguggcuggucauacuauugcgcugggcugaagaaagucacagaagugaagggauauacaaaaggaggaccuggacacgaggaaccaaucccaauggcgaccuauggauggaaccuaguaaaacugcauuccgggaaagacguauucuuuacaccaccugagaaaugugacacccuuuugugugauauuggugaguccucuccaaacccaaccauagaagaaggaagaacguuacgcguccuaaaaaugguggaaccauggcucagagggaaccaauuuugcauaaaaauucuaaaucccuacaugccaagugugguggaaacucuggagcaaaugcaaagaaaauauggaggaaugcuagugcgaaauccacuuucaagaaauucuacucaugaaauguauuggguuucaugugggacaggaaacauugugucagcaguaaacaugacaucuagaauguugcuaaaucgauucacaauggcucacaggaaaccaacauaugaaagagacguggaccuaggcgcuggaacuagacauguggcaguggaaccagagguagccaaccuggauaucauuggccagaggauagagaacauaaaacaugaacacaagucaacauggcacuaugaugaggacaauccauauaaaacaugggccuaucacggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacgcgcacaccaaaagcaaaacgaggcacagcacaaaucauggaggugacagccagaugguuaugggguuuucuuucuagaaacaaaaaaccaagaauuuguacaagagaggaguucacaagaaaagucaggucaaacgcagccauuggagcaguguucguugaugaaaaucaauggaacucagcaaaagaagcaguggaagaugagcgguucugggaccuugugcaaaaagagagggagcuucacaaacagggaaaaugugccacguguguuuacaacaugauggggaagagagagaaaaagcuaggagaguuuggaaaggcaaaagggagucgugcaauaugguacaugugguugggagcacguuuucuagaguuugaagcucuugguuucaugaacgaagaucacugguucaguagagagaauucacucagcggaguggaaggagaaggacuccacaaacucggauacauacucagagacauaucaaagauuccagggggaaauauguaugcagaugacacagccggaugggauacaaggauaacagaggaugaucuucagaaugaggccaaaauuacugacaucauggagcccgaacaugcccuacuggcuacgucaaucuucaagcugaccuaccaaaauaagguggugaggguucagagaccagcaaaaaauggaaccgugauggaugucauauccagacgugaccaaagaggaaguggccaggucggaacuuauggcuuaaacacuuuuaccaacauggaagcccagcuaauaagacaaauggagucugagggaaucuuuuuacccagcgaauuggagaccccaaacuuagccgagaggguucucgacuggcuggaaaaauauggcgucgaaaggcugaaaagaauggcaaucagcggagaugacugcguggugaaaccaauugaugacagguucgcaacagcccuaacagcucugaaugauaugggaaaaguaagaaaagauauaccacaaugggaaccuucaaaaggauggaaugacuggcaacaagugccuuuuuguucacaccacuuccaccagcugauaaugaaggacgggagggaaauaguggugccaugccguaaccaagaugaacuuguggguagggcuagaguaucacaaggugcuggauggagccugagagaaacugcaugccuaggcaagucauaugcacaaauguggcagcugauguacuuucacaggagagaccugagacuagccgccaaugcuaucuguucagccguuccaguugauugggucccaaccagucgcaccaccuggucgauccaugcccaccaccaauggaugacaacagaagacauguugucaguguggaauaggguuuggauagaggaaaacccauggauggaggacaaaacccauguauccaguuggggagauguuccauaucuagggaaaagggaagaucagugguguggaucccugauaggcuuaacagcaagggccaccugggccuccaacauacaaguggccauaaaccaagugagaagacuaauugggaaugagaauuaucuagauuacaugacaucaaugaagagauucaagaacgagggugaucccgaaggggcacucugguga

SEQ ID NO: 5869 - RNA, 9879 nt, Artificial Sequence
  derived and/or modified CDS sequence (wt) from DENV-1__GQ199795__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguuaugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcuacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuuuuagaccuaccacugccuuggaccucgggagcuucaacaucacaagagaccuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggcuuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucagaggagaagaugggugcugguacgguauggaaaucagaccagucaaggaaaaggaagaaaaucuagucaaaucaauggucucugcagggucaggggaaguggacagcuuuucacuaggacugcuauguauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucagguuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugccgcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagagaaaccuugugaaaccagaagggaaagucauagaccucgguuguggaagagguggcuggucauacuauugcgcugggcugaagaaagucacagaagugaagggguauacaaaaggaggaccuggacaugaggacccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuaugggguuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga

SEQ ID NO: 5870 - RNA, 9873 nt, Artificial Sequence
  derived and/or modified CDS sequence (wt) from DENV-1__FJ882547__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacauguguacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuaucuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcagauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaagggaagaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugaaaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuccgacaggauggggauaggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauguuaaaauuguugacugacuuucaaucacaucagcugugggcuaccuugcuguccuugacauuuaucaaaacaacauuuucuuugcacuaugcauggaagacaauggcuaugguacugucaauuguaucucucuuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaacauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguugugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgccuccugucucccgugagaguucccaauuacaacaugauuaucauggaugaagcacauuuuacagauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucaccgauuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacguugucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaggaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacggguggagugacgcuguucuuccuaucaggaaggggccuagggaaaacaucuaucggucuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggagaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucucugacagccauugcaaaccaggcagcuauauugaugggacuugacaaaggauggccaauaucgaagauggacauagggguuccacuucucgcuuuggggugcuauucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucucuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugagucaucuccaaacccaacuauagaggaaggaagaacgcuacgcguccuaaagaugguggaaccauggcucagaggaaaccaauucugcauaaaaauucugaaucccuacaugccaagugugguggaaacucuggaacaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauauaaaacaugggccuaucauggaucauaugaggucaagccaucaggaucagccucauccauggucaauggcguggugaaacugcucaccaaaccaugggaugucauccccaugucaccaauagccaugacugacacuacaccuuuggcacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacaugcccuacuggcuaaggcaauuuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugaggaaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacaggagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccacuaacauacaaguggcuauaaaccaagugagaagacuaauugggaaugagaauuaucuagauuacaugacaucaaugaagagauucaagaacgagagugaucccgaaggggcacucugguga

SEQ ID NO: 5871 - RNA, 9879 nt, Artificial Sequence
  derived and/or modified CDS sequence (wt) from DENV-1__GQ199797__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaaguguguuacaaaacuggaaggaaagacaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagaaaagauuugcuggugacauuuaagacagcucaugcaaagaagcaagaaguagucguacuaggaucacaagaaggagcaaugcacacugcguugaccggagcaacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacaguuacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagguccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuguuccgcagacuaacauccagagaaguacuccuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuuaugccuguccacgacuucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaaguucagccgaccuaucacuagagaaagcagcugaggucuccugggaagaagaagcagaacacucuggugccucacacaacauauuaguagagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccaguguaaaaaaagaccugaucucauauggaggagguuggaggcuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuugacaauaauggaccuacauccaggaucggggaaaacaagaagauaucuuccagccauaguccgugaggccauaaaaaggaagcugcgcacauuaauucuggcucccacaagaguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuauuauggaugaagcacauuucaccgauccauccagcauagcggccagaggguacaucucaacccgagugggcaugggugaagcagcugcgaucuucaugacagcuacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguauaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacguacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucugguuauguugcacaacuccgaacaaggaggaagagccuauagacaugcaauggaggaacugccagacaccauagaaacgaugaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccuaacagccauugcaaaccaggcggcuauauugaugggacuugacaaaggauggccaauaucgaagauggacauaggaguuccacuucucgccuuagggugcuauucccaggugaauccacugacgcugacagcggcgguguugaugcuaguggcucauuacgccauaauuggaccuggacugcaagcaaaagcuacuagagaagcucaaaaaaggacagcggccggaauaaugaaaaauccaaccguugauggaauaguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcucugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauuggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacagaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuccagaacgaggccaaaauuacugacaucauggaacccgaacaugcccuacuggcuaagucaaucuucaaacuaacauaccaaaacaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaauuuuuucacccagcgaauuagagaccccaaauuuagccaggagaguucuugacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccaguugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaucaagugagaagacuaauugggaaugagaauuaucuagauuacaugacaucaaugaagagauucaagaacgagagugauccugaaggugcacucugguga

SEQ ID NO: 5872 - RNA, 9879 nt, Artificial Sequence
  derived and/or modified CDS sequence (wt) from DENV-1__GQ199799__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaaggaccgaaacguggauguccucugaaggcgcuuggaaacagauacaaagaguggaaacuugggcccugagacacccaggauucacggugauagcccuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaagccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacaggagaccagcaccaggugggaaaugaaagcacagaacaugggacaacugcaacuauaacaccucaagcuccuucaacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaagagacuuggaacagacaagauuugcuggugacauucaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaaaggaguaacccagaaugggagacuaauaacagccaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguuccauaggaggaguguucacgucugucggaaaauuaguacaccagaucuuuggaacugcauauggagucuuguucagcgguguuuccuggaccaugaaaauaggaauaggaguucugcugacauggcuagguuuaaacucaaggagcacgucccuuucgaugacgugcauugcaguuggccuaguaacauuauaccuaggagucaugguucaggcggauucaggauguguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaagguguguguggaauacgaucagcaacucgucucgagaacaucauguggaagcaaauaucaaaugaacugaaccacaucuuacuugaaaaugacaugaaacucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugauaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggauagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuugaaauuauugacugacuuucaaccacaucaguugugggcuaccuugcuguccuugacauuuaucagaacaacguuuuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcaguuucagggguguacccauuaucaauaccagcaacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguaggaguaggaguuuuucaagaaaacguguuccacacaauguggcaugucaccaggggagcuguucucauguaucaagggaagaggcuggaaccgagcugggccagugucaaaaaagaccugaucucauauggaggagguuggaggcuucaaggauccuggaacacgggagaagaagugcaggugauugcuguugaaccaggaaaaaacccaaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaggcugcgcacauuaauuuuggcucccacaaggguugucgcuuccgaaauggcagaggcgcucaagggaaugccaauaagguaccaaacaacagcagugaagagugaacacacaggaaaagagauaguugaucucaugugucacgccacuuucacuaugcgccuccugucucccgugagaguucccaauuacaacaugauuaucauggaugaagcgcauuucaccgauccauccagcauagcggccagaggguacaucucaacccgagugggcaugggugaggcagcugcgaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcaucaaaucaggaaaugacauugccaacugcuuaagaaagaaugggaaacgggugauucaauugagcaggaaaacuuuugauacagaguaccaaaaaacaaaaaauaacgacugggacuacguugucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugacaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagagcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuauucuuccuaucaggaaggggccuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagcuaaugagaugggacugcuggaaaccacaaagaaagacuuagggaucggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucacuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacgcugggagagaaauggaaaagacagcugaaccaacugaguaagucagaauucaacacuuauaaaaggagugggaucauggaaguggacagauccgaagccaaagagggacugaaaagaggagaaacaaccaaacacgcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacaaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauuccacucaugaaauguauuggguuucauguggaacaggaaacauugugucagcaguaaacaugacauccagaauguugcuaaaccgauucacaauggcucacaggaaaccaacauaugaaagagacguggaccuaggcgccggaacaagacauguggcaguggaaccagagguagccaaccuagacaucauuggccagaggauagagaacauaaaacaugaacauaagucaacauggcauuaugaugaggacaacccauauaaaacaugggccuaccauggaucauaugagguuaagccgucaggaucagccucauccauggucaauggcguggugaaacugcucaccaaaccaugggaugucauccccauggucacacaaauagccaugacugacaccacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugcuacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauguauccaguuggggagauguuccauauuuaggaaaaagggaagaucaaugguguggaucccugauaggcuuaacagcaagggccaccugggccaccaacauacaaguggccauaaaccaagugagaagacuacuugggaaugagaauuaucuagauuacaugacaucaaugaagagguucaagaaugagagugauccugaaggggcacucugguga

SEQ ID NO: 5873 - RNA, 9879 nt, Artificial Sequence
  derived and/or modified CDS sequence (wt) from DENV-1__GQ199800__SS-prME
ucugugaccaugcuccucaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagaguuuugugaggacacaaugacuuacaagugcccucgaaucacugaggcggaaccagaugacguugauuguuggugcaaugccacagacacaugggugaccuauggaacauguucccaaacuggcgagcaccgacgcgacaaacguuccgucgcacuggccccacacgugggacuugguuuggaaacaagaaccgaaacguggauguccucugagggcgcuuggaaacagauacaaagaguggagacuugggcccugagacacccaggauucacggugauagcucuuuuucuagcacaugccauaggaacauccaucacccagaaagggauuauuuucauucuguuaaugcugguaacaccauccauggcaaugcgaugugugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagaugcccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaaaacuggaaggaaagauaguucaauaugaaaacuugaaauauucaguaauagucaccguccacacuggagaccagcaccaggugggaaaugaaagcacagaacaugggacaacugcaacuauaacaccucaagcuccuucgacggaaauacagcugaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacgucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagauuaaagauggauaagcugacucuaaaggggaugucauauguaaugugcacaggcucauucaagcuagagaaagaaguggcugagacccagcauggaaccguucuagugcagauuaaauaugaaggaacagaugcaccaugcaagaucccuuuuuugacccaagaugaaaaaggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacuaggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacgugcauugcaguuggccuaguaacauuauaccuaggagucaugguucaggcggauucaggaugcguaauuaauuggaaagguagagaacucaaauguggaaguggcauuuuugucaccaaugaaguucacacuuggacagagcaauacaaauuucaagcugacuccccaaagagacuaucagcagccaucgggaaggcaugggaggaggguguguguggaauacgaucagcaacucgucucgagaacaucauguggaagcaaauaucaaaugaacugaaccacaucuuacuugaaaaugacaugaaauucacagugguuguaggagauguugcuggaaucuuggcucaaggaaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucuuucauagaaguuaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggccguguucuuccuucucauaaugggacaacugacauggaaugaucugaucagauuaugcaucaugguuggagccaacgcuuccgacaggauggggaugggaacgacguaccuagcucugauggccacuuuuaaaaugagaccaauguuugcuguaggacuauuauuccgcagacuaacauccagagaaguacuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguuuuccuugcacuaugcauggaagacaauggccaugguacugucaauuguaucucucuuccccuugugccuguccacaaccucccaaaaaacaacauggcuuccggugcuauugggaucucuuggaugcaaaccacuaaccauguuucuuauagcagaaaacaaaaucuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagacuggaaccgagcugggccagugucaaaaaggaccugaucucauauggaggagguuggagacuucaaggauccuggaacacgggagaagaagugcaggugauugcuguugaaccaggaaaaaaccccaaaaauguacaaacagcgccgggcaccuuuaagaccucugaaggugaaguuggagccauugcccuagauuucaaacccggcacaucuggaucucccaucgugaacagagaaggaaaaauaguaggucuuuacggaaauggaguagugacaacaaguggaaccuacgucagugccauagcucaagccaaagcaucacaagaagggccucuaccagagauugaagacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacauuucaacccgagugggcaugggggaagcagcugcgaucuucaugacagcuacucccccaggaucaguggaggccuuuccacagaguaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaauugagcagaaaaacuuuugauacagaguaccaaaaaacaaaaaauaacgacugggacuacgucgucacaacagacaucuccgaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggaaagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaagaagcgucucaggugaucuaauauuagaaauagggaaacuuccacaacacuugacgcaaagggcccagaaugccuuggacaaucuggucauguugcacaacuccgaacaaggaggaagagccuauagacaugcaauggaggaauugccagacaccauagaaacguugaugcuccuagcuuugauagcuguguuaacugguggagugacgcuguucuuccuaucaggaagaggccuagggaaaacaucuaucggccuacucugcgugauggcuucaagcguacugcuauggauggccaguguggagccccauuggauagcggccuccaucauauuggaguucuuccugauggugcugcuuauuccagagccagacagacaacgcacuccgcaggacaaccagcuggcauacguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcggcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuuuauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauuuugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacauccagaauguugcuaaaucgauucacaauggcucacaggaaaccaacguaugaaagagacguggaccuaggcgccggaacaagacauguggcaguggaaccugagguagcuaaccuagauaucauuggccagaggauagagaacauaaaacaugaacauaagucaacauggcauuaugaugaggacaauccauacaaaacaugggccuaccauggaucauaugaggucaagccaucaggaucagccucauccaugguuaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggaggugacagccaagugguuaugggguuuucuuucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuccuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuaccgacaucauggaacccgaacaugcccuacuggcuaagucaaucuucaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauacuuagggaaaagggaagaucaaugguguggaucccugauaggcuuaacagcaagggccaccugggccaccaacauacaaguggccauaaaccaagugagaagacuaauugggaacgagaauuaucuagauuacaugacaucaaugaagagauucaagaacgagagugauccugaaggggcacucugguga

SEQ ID NO: 5874 - RNA, 9879 nt, Artificial Sequence
  derived and/or modified CDS sequence (wt) from DENV-1__FJ882548__SS-prME
ucugugaccaugcuccuuaugcugaugccuacagccuuggcguuccauuugaccacacgagggggagagccgcacaugauagucagcaagcaggaaagaggaaagucacuuuuguuuaagaccucagcaggugucaacaugugcacccuuauagcgauggauuugggagaguuaugugaggacacaaugacuuacaaaugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccuccgaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguuacaccauccauggccaugcgaugcgugggaauaggcagcagggacuucguggaaggacugucaggagcaacuuggguagaugugguacuggaacauggaaguugcgucacuaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacugguggaagaacaagacgcgaacuuugugugucgacgaacguuuguggacagaggcuggggcaauggcugugggcucuucggaaaaggaagccuaauaacgugugcuaaguuuaagugugugacaaaacuggaaggaaagauaguccaauaugaaaacuugaaauacucaguaauagucaccguccacacuggagaccagcaccaggugggaaaugaaagcacagaacaugggacaacugcaacuauaacaccucaagcuccuacgacggaaauacagcuaaccgacuacggagcucuuacauuggauuguucaccuagaacaggacuagacuuuaaugaaaugguguuguugacaaugaaagaaaaaucauggcuaguccacaaacaaugguuucuagaccuaccacugccuuggaccucgggagcuucaacaucacaggaaacuuggaacagacaagauuugcuggugacauuuaagacagcucaugcaaagaagcaggaaguagucguacuaggaucacaagaaggagcaaugcacacugcgcugaccggagcgacagaaauccaaacgucuggaacgacaacaauuuuugcaggacacuugaaauguagacuaaagauggacaaacugacucuaaaagggaugucauaugugaugugcacaggcucauucaagcuagagaaagagguggcugagacccagcauggaaccguucuagugcagauuaaauacgaaggaacagaugcaccaugcaagauccccuuuucgacccaagaugagaaaggaguaacccagaaugggagauugauaacagccaaccccauagucacugacaaagaaaaaccagucaacauugaggcagaaccgccuuuuggugagaguuacaucgugauaggagcaggugaaaaagcuuugaagcuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaauacaccagauuuuuggaacugcauauggaguuuuguucagcgguguuuccuggaccaugaaaauaggaauagggguucugcugacauggcuaggauuaaacucaaggagcacgucccuuucgaugacgugcauugcagucggccuaguaacgcuauacuuaggagucaugguucaggcggauucaggauguguaauuaacuggaaagguagagaacucaaauguggaaguggcauuuuuguuaccaaugaaguucauacuuggacagagcaauacaaauuucaagcugauuccccaaagagacuaucagcagccauugggaaggcaugggaggaggguguguguggaauucgaucagcaacucgucucgagaacaucauguggaagcaaauaucaaaugaauugaaccacaucuuacuugaaaaugacaugaaacucacagugguuguaggagauguugcugggaucuugggccaaggaaaaaaaaugauuaggccacaacccauggaauauaaauacucguggaaaagcuggggaaaggcuaaaaucauaggggcagaugcacagaacaccaccuucaucaucgacggcccaaacaccccggaaugcccugaugaucaaagagcauggaacauuugggaaguugaggauuauggauuuggaauuuucacgacaaacauauggcugaaauugcgugacuccuacacccaagugugugaccaccggcuaaugucagcugccaucaaggacagcaaggcaguucacgcugacaugggguacuggauagaaagugagaagaacgagaccuggaagcuggcaagagccucuuucauagaagucaaaacauguaucuggccaaaaucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuuguacgcuaccacccuuacguuucagaggagaagaugggugcugguacgguauggaaaucagaccaguuaaggaaaaggaagagaaucuagucaaaucaauggucucugcagggucaggggaaguggacagcuuuucacuaggacugcuaugcauaucaauaaugaucgaagaggugaugagauccagauggaguagaaaaaugcugaugacuggaacacuggcuguguucuuccuucucauaaugggacaauugacauggaaugaucugaucagauuaugcaucaugguuggagccaacgccuucgacaggauggggaugggaacgacguaucuagcucugauggccacuuuuaaaaugagaccaauguuugcuguggggcugcuauuccgcagacuaacauccagagaaguucuucuucuaacaauuggauugagucuaguggcaucuguggaguuaccaaauuccuuggaggagcugggggauggacuugcaaugggcauuaugauuuuaaaauuguugacugacuuucaaucacaucagcugugggcuaccuugcuguccuugacauuuaucaaaacaacauuuucuuugcacuaugcauggaagacaauggcuaugguacugucaauuguaucucuccuccccuuaugccuguccacgaccucccaaaaaacaacauggcuuccggugcuauugggaucucuuggaugcaaaccacuaaccauguuucuuauagcagaaaacaaaauuuggggaaggaaaaguuggccccucaaugaaggaaucauggcuguuggaauagucagcauccuacuaaguucacuccucaaaaaugaugugccgcuagcugggccacuaauagcuggaggcaugcuaauagcauguuauguuauaucuggaagcucagccgaucuaucacuagagaaagcggcugaggucuccugggaagaagaagcagaacacucuggugccucacacaauauacuaguggagguccaagaugauggaaccaugaagauaaaggaugaagagagagaugacacgcuaaccauucuccuuaaagcaacucugcuagcaguuucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaaucaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuucgaggauccuggaacacgggagaagaagugcaggugauugcuguugaaccagggaaaaaccccaaaaauguacaaacggcgccgggcaccuuuaagaccccugaaggcgaaguuggagccauugcucuagauuuuaaacccggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaccuuccagccauaguccgugaggccauaaaaaggaagcugcguacacuaauucuggcucccacaaggguugucgcuuccgaaauggcagaggcgcucaagggaaugccaauaagguaccaaacaacagcagugaagagugaacacacaggaaaagagauaguugaccucaugugucacgccacuuucaccaugcgucuccugucucccgugagaguucccaauuacaacaugauuaucauggaugaagcacauuuuacagauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggccaugaguggaucaccgacuucccaggcaaaacaguuugguuuguuccaagcauuaaaucaggaaaugacauugccaacugcuuaagaaagaaugggaagcgggugauucaauugagcaggaaaaccuuugacacagaguaccaaaaaacaaaaaauaacgacugggacuacgucgucacaacagacaucuccgaaaugggagcgaauuuccgggccgacagggugauagacccaagacggugucugaaaccgguaauacuaaaggaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucacgcucacuggacggaagcaaaaaugcuccuugauaauauaaacacaccagaagggauuaucccagcccucuucgagccggagagagaaaagagugcagcaguagacggggaauacagacugcgaggugaagcaaggaaaacguuuguggagcucaugagaagaggagaucuaccugucuggcuauccuacaaaguugcuucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuggcccugcgcgaguuuaaagaguuugcagcaggaagaagaagcgucucaggugaucuaauauuagaaauaggaaaacuuccacaacacuugacgcaaagggcccagaaugccuuggacaaccugguuaugcugcacaauuccgaacaaggaggaagagccuauagacaugcaauggaagaacugccagacaccauagaaacguuaaugcuccuagcuuugauagcuguguuaacugguggagugacgcuguucuuccuaucaggaaggggccuagggaaaacaucuaucggccuacucugcgugauggcuucaagcguacugcuauggauggccaguguggagccccauuggauagcggccuccaucauacuggaguuuuuccugauggugcugcuuauuccagagccagacagacaacgcacuccgcaggacaaccagcuggcauauguggugauagguuuguuauucaugauacuaacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaaucaucacucccaugaugaggcacacaaucgaaaacacaacagcaaacauuucccugacagccauugcaaaccaggcagcuauauugaugggacuugacaaaggauggccaauaucgaagauggacauagggguuccacuucucgcuuuggggugcuacucccaggugaauccacugacgcugacagcggcgguauugaugcuaguggcccauuacgccauaauuggaccuggacugcaagcaaaagcuacuagagaagcucaaaaaaggacagcggccggaauaaugaaaaauccaaccguugauggaaucguugcaauagauuuggacccugugguuuaugaugcaaaauuugagaaacaacuaggccaaauaauguuguugauacuaugcacaucacagauccucuugaugcggacuacaugggccuugugcgaauccaucacacuggccacuggaccucugaccacgcuuugggagggaucuccaggaaaauuuuggaacaccacgauagcgguuuccauggcaaacauuuucagaggaaguuauuuagcaggagcaggucuggccuucucauuaaugaaaucccuaggaggagguaggagaggcacaggagcccaaggggaaacacugggagagaaauggaaaagacagcugaaccaacugagcaagucagaauucaacaccuauaaaaggagugggauuauggaaguggacagaucugaagccaaagagggacugaaaagaggagaaacaaccaaacaugcagugucgagaggaaccgcuaaauugaggugguuuguggagaggaaccuugugaaaccagaagggaaagucauagaccucgguuguggaagagguggcuggucauacuauugcgcugggcugaagaaggucacagaagugaagggauauacaaaaggaggaccuggacaugaagaaccaaucccaauggcgaccuauggauggaaccuaguaaagcugcacuccgggaaagacguauucuucauaccaccugagaaaugugacacccuuuugugugauauuggugaguccucuccaaacccaacuauagaggaaggaagaacgcuacgcguccuaaagaugguggagccauggcucagaggaaaccaauucugcauaaaaauucugaaucccuacaugccaagugugguggaaacucuggagcaaaugcaaagaaaacauggaggaaugcuagugcgaaauccacuuucaagaaauucuacccaugaaauguauuggguuucauguggaacaggaaacauugugucagcaguaaacaugacauccagaauguugcuaaaucgauucacaauggcucacaggaaaccaacauaugaaagagacguggaccuaggcaccggaacaagacauguggcaguggaaccagagguagccaaccuagauauuauuggccagaggauagagaacauaaaacaugaacacaagucaacauggcauuaugaugaggacaauccauacaaaacaugggccuaucauggaucauaugaggucaagccaucaggaucagccucauccauggucaauggcguggugaaacugcucaccaaaccaugggaugucauccccauggucacacaaauagccaugacugacacuacacccuuugggcaacagaggguguuuaaagagaaaguugacacacgcacaccaaaagcaaaacgagguacagcacaaaucauggaggugacagccaggugguuaugggguuuucuuucuagaaacaagaaaccaagaauuuguacaagagaggaguucacaagaaaaguuaggucaaacgcagccaucggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguuuggaaaggcaaaaggaagucgugcaauaugguacaugugguugggagcacguuuucuagaguucgaagcucuugguuucaugaacgaagaccacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccaaaauuacugacaucauggaacccgaacacgcccuacuggcuaaggcaaucuucaagcuaaccuaccaaaauaaagugguaaggguacagagaccagcaaaaaauggaaccgugauggauguuauauccagacgugaccagagaggaaguggccaggucggaacuuauggcuuaaacacuuucaccaacauggaagcccagcugauaagacaaauggagucugagggaaucuuuucacccagugaauuagagaccccaaauuuagccgagagagcucucgauuggcuggaaaaauauggcgucgaaaggcuaaaaagaauggcaaucaguggagaugauugcguagugaaaccaauugaugauagguuugcaacagccuuaacagcucugaaugauaugggaaaaguaagaaaagauauaccacaaugggaaccuucaaaaggauggaaugauuggcagcaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaaaucauaugcacaaauguggcagcugauguacuuccacagaagagaccuaagacuagccgcuaaugcuaucuguucagccguuccaguugauugggucccaacuagccgcaccaccuggucgauccaugcccaucaccaauggaugacaacagaagacaugcugucaguguggaauaggguuuggauagaggaaaacccauggauggaggacaaaacccauauauccagcugggaagauguuccauauuuagggaaaagggaagaucaaugguguggaucccugauaggcuuaacagcaagggccaccugggccaccaacauacaaguggcuauaaaccaagugagaagacuaauugggaaugagaauuaucuagauuacaugacaucaaugaagagauucaagaacgagagugaucccgaaggggcacucugguga

SEQ ID NO: 5875 - RNA, 9879 nt, Artificial Sequence
  derived and/or modified CDS sequence (wt) from DENV-1__GQ199801__SS-prME
ucugugaccaugcuccuuaugcugaugccuacagccuuggcguuccauuugacuacacgagggggagagccgcacaugauagucagcaagcaggaaagaggaaagucacuuuuguuuaagaccucagcaggugucaacaugugcacccuuauagcgauggauuugggagagcuuugugaggacacaaugacuuacaagugcccucgaaucacugaggcggaaccagaugacguugauuguuggugcaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuaucuucauucuguuaaugcugguaacaccauccauggcaaugcgaugugugggaauaggcagcagggacuucguggaaggacugucaggagcaacuuggguagauguaguacuggaacauggaaguugcgucaccaccauggcaaaagacaaaccaacauuggacauugaacucuugaagacggaagucacaaacccugccguccugcguaaacugugcauugaagcuaaaauaucaaacaccaccacugacucaagauguccaacacaaggagaagccacacugguggaagaacaagacgcgaacuuugugugucgacgaacguuuguggacagaggcuggggcaauggaugugggcucuucggaaaaggaagccuaauaacgugugcuaaguucaagugugugacaagacuggaaggaaagauaguucaauaugaaaacuugaaauauucagugauagucaccguccacacuggagaccagcaccaggugggaaaugaaagcacagaacacgggacaacugcaacuauaacaccucaagcuccuucaacggaaauacagcugaccgacuacggagcucuuacauuggauuguucaccuagaacaggacuagacuucaaugaaaugguguuguugacaaugaaagaaaaaucauggcuaguccacaaacaaugguuucuagaccuaccacugccuuggaccucgggagcuucaacaucacaagagacuuggaacagacaagauuugcuugugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaauguagacuaaagauggacaagcugacucuaaaagggaugucauauguaaugugcacaggcucauucaagcuagagaaagaaguggcugagacccagcauggaaccguucuagugcagauuaaauaugaaggaacagaugcaccaugcaagaucccuuuuucgacccaagaugaaaagggaguaacccagaaugggagacuaauaacagcuaaccccauagucacugacaaagaaaaaccagucaacauugaggcagaaccgccuuuuggugagaguuacaucgugauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauaggaguucugcuaacauggcuaggauuaaacucaaggagcacgucccuuucgaugacaugcauugcaguuggccuaguaacauuauaccuaggagucaugguucaggcggauucaggauguguaauuaauuggaaaggcagagaacucaaauguggaaguggcauuuuugucaccaaugaaguucacacuuggacagagcaauacaaauuucaagcugacuccccaaagagacuaucagcugccaucgggaaggcaugggaggaggguguguguggaauacgaucagcaacucgucucgagaacaucauguggaagcaaauaucaaaugaacugaaccacaucuuacuugaaaaugacaugaaauucacaguggucguaggagauguugcuggaaucuuggcucaagggaaaaaaaugauuaggccacaacccauggaauacaaauacucguggaaaagcuggggaaaggcuaaaaucauaggggcagaugugcagaauaccaccuucaucaucgacggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuagcaagagccucuuucauagaagucaaaacauguaucuggccaaagucccacacucuauggagcaauggaguucuggaaagugaaaugauaauuccaaagaucuauggaggaccaauaucucagcacaacuacagaccaggauauuucacacaaacggcagggccguggcaccuaggcaaguuggaacuggauuuuaauuugugugaggguaccacaguuguuguggaugaacauuguggaaaucgaggaccaucucuuaggaccacaacagucacaggaaagauaauucaugaaugguguugcagaucuuguacgcuaccacccuuacguuucaaaggagaagaugggugcugguacgguauggaaaucagaccagucaaggaaaaggaagagaaucuagucaaaucaauggucucugcagggucaggggaaguggacagcuuuucacuaggacugcuaugcauaucaauaaugaucgaagaggugaugagauccagauggaguaaaaaaaugcugaugacuggaacacuggcuguguucuuccuucucauaaugggacaauugacauggaaugaucugaucagauuaugcaucaugguuggagccaacgcuuccgacaggauggggaugggaacgacguaccuagcucugauggccacuuuuaaaaugagaccaauguuagcuguaggacuauuauuccgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucaguugugggcuaccuugcuguccuugacauuuaucaaaacaacguauuccuugcacuaugcauggaagacaauggccaugguacugucaauuguaucucucuuccccuuaugccuguccacgaccucccaaaaaacaacauggcuuccggugcuauugggaucucuuggaugcaaaccacuaaccauguuucucauagcagaaaacaaaaucuggggaaggaaaaguuggccccucaaugaaggaaucauggcuguuggaauagucagcauucuacuaaguucacuccucaaaaaugaugugccgcuagcugggccacuaauagcuggaggcaugcuaauagcauguuauguuauaucuggaagcucagccgaccuaucacuagagaaagcagcugaggucuccugggaagaagaagcagaacacucuggugccucacacaacauauuaguggagguccaagaugauggaaccaugaagauaaaggaugaagagagagaugacacgcuaaccauucuccuuaaagcaacucugcuagcagucucagggguguacccauuaucaauaccagcgacccuuuuugugugguacuuuuggcagaaaaagaaacagagaucuggaguguuaugggacacaccuagcccuccagaaguggaaagagcaguucuugaugaugguaucuauagaauuaugcagagaggacuguugggcaggucccaaguagggguaggaguuuuucaagaaaacguguuccacacaauguggcaugucaccaggggagcuguacucauguaucaagggaagagacuggaaccgagcugggccagugucaaaaaagaccugaucucauauggaggagguuggaggcuccaaggauccuggaacacgggagaagaagugcaggugauugcuguugaaccaggaaaaaaccccaaaaauguacaaacagcgccgggcaccuuuaagaccucugaaggugaaguuggagccauugcccuagauuuuaaacccggcacaucuggaucucccaucgugaacagagaaggaaaaauaguaggucuuuacggaaauggaguagugacaacaaguggaaccuacgucagugccauagcucaagccaaagcaucacaagaagggccccuaccagagauugaaaacgagguguuuaggaaaagaaacuuaacaauaauggaccuacauccaggaucggggaaaacaagaagauaucuuccagccauaguccgugaggccauaaaaaggaagcugcgcacauuaauucuggcucccacaaggguugucgcuuccgaaauggcagaggcgcucaagggaauaccaauaagguaccaaacaacagcagugaagagugaacacacaggaaaagagauaguugaccucaugugucacgccacuuucacuaugcgccuccugucucccgugagaguucccaauuacaacaugauuaucauggaugaagcacauuucaccgauccauccagcauagcggccagaggguacaucucaacccgagugggcaugggugaagcagcugcgaucuucaugacagccacucccccaggaucaguggaggccuuuccacagagcaacgcaguuauccaagaugaggaaagagacauuccugagagaucauggaacucaggcuaugaguggaucacugacuucccggguaaaacaguuugguuuguuccaagcaucaaaucaggaaaugacauugccaacugcuuaagaaagaaugggaaacgggugauucaguugagcagaaaaacuuuugauacagaguaccaaaaaacaaaaaauaacgacugggacuacgucgucacaacagacaucucugaaaugggagcaaauuuccgggccgacagggugauagacccaagacggugucugaaaccgguaauacuaaaagaugguccagagcgugucauuuuagcaggaccgaugccagugacuguggccagugccgcccagaggagaggaagaauuggaaggaaccacaauaaggaaggugaucaguacaucuacaugggacagccuuuaaacaacgaugaagaucaugcucacuggacagaagcaaaaaugcuccuugauaauauaaacacaccagaagggauuaucccagcccucuucgagccggagagagaaaagagugcagcaauagacggggaauauagacugcggggugaagcaaggaaaacguuuguggagcuuaugagaagaggagaucuaccugucuggcuauccuacaaaguugccucagaaggcuuucaguacucugacagaagauggugcuuugacggggaaaggaacaaccagguguuggaggagaacauggacguggagaucuggacaaaagaaggagaaagaaagaaacuaagaccccgcuggcuggaugcuagaacauacucagacccacuggcccugcgcgaguuuaaagaguuugcagcaggaagaaggagcgucucaggugaucuaauauuagaaauagggaaacuuccacaacaccugacgcaaagggcccagaaugccuuggacaaucugguuauguugcacaacuccgaacaaggaggaagagccuauagacaugcaauggaagaacugccagacaccauagaaacguugaugcuccuagcuuugauagcuguguuaacugguggagugacgcuguucuuccuaucaggaaggggcuuagggaaaacaucuaucggccuacucugcgugauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggauguagacuuacauccagcuucagccuggacccucuaugcaguggccacaacaauuaucacucccaugaugaggcacacaaucgaaaacacaacggcaaacauuucccugacagccauugcaaaccaggcggcuauauuaaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggauccugugguuuaugaugcaaaauuugagaaacaacuaggccaaauaauguuguugauacuaugcacaucacaaauccucuugaugcggacuacaugggccuugugcgaauccaucacacuagccacuggaccucugaccacgcuuugggagggaucuccaggaaaauuuuggaacacuacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccagcugagcaagucagaauucaacacuuauaaaaggagugggaucauggaaguggacagauccgaagccaaagagggacugaaaagaggagaaacaaccaaacaugcagugucgagaggaacagcuaaacugaggugguuuguggagaggaaucuugugaaaccagaagggaaagucauagaccucgguuguggaagagguggcuggucauacuauugcgccgggcugaagaaagucacagaagugaagggauauacgaaaggaggaccuggacaugaggagccaauuccaauggcgaccuauggauggaaccuaguaaaacugcacuccgggaaagacguauucuucauaccacccgagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaauauugugucagcaguaaacaugacauccagaauguugcuaaaucgauucacaauggcucacaggaaaccaacguaugaaagagacguggaccuaggcgccggaacaagacauguggcaguggaaccugagguagccaaccuagauaucauaggccagaggauagagaacauaaaacaugaacauaagucaacauggcauuaugaugaggacaauccauauaaaacaugggccuaccauggaucauaugaggucaagccaucaggaucagccucauccauggucaauggcguggugaaacugcucaccaaaccaugggaugucauccccauggucacacaaauagccaugacugacacuacacccuuuggacaacagaggguguucaaagagaaaguugacacacgcacaccaaaagcaaaacgaggcacagcacaaaucauggagguuacagccaagugguuaugggguuuucucucuagaaacaagaaaccaagaauuuguacaagagaggaguucacaagaaaaguuaggucaaacgcagccauuggagcaguguucguugaugaaaaucaauggaacucagcaaaagaagcaguggaagaugagcgguucugggaccuugugcacagagagagggagcuucacaaacagggaaaaugugccacguguguuuacaacaugauggggaagagagagaaaaaacuaggagaguucggaaaggcaaaaggaagucgugcaauaugguacauguggcugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaacgaggccaaaauuacugacaucauggaacccgaacaugcccuacuggcuaagucgaucuuuaagcuaacauaccaaaauaaggugguaaggguacagagaccagcaaaaaauggaaccgugauggaugucauauccagacgugaccagagaggaaguggccaggucggaacuuauggcuuaaacacuuucaccaacauggaagcccagcugauaagacagauggagucugagggaaucuuuucacccagcgaauuagagaccccaaauuuagccgggagaguucucgacuggcuggaaaaacauggcgucgaaaggcugaaaagaauggcaaucagcggagaugacugcguagugaaaccaauugaugauagguuugcaacagccuuaacagcucugaaugauaugggaaaaguuagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcaguugauguacuuccacaggagagaccugagacuagccgcuaaugcuaucuguucagccguuccaguugauugggucccaaccagccgcaccaccuggucgauccaugcccaucaccaauggaugacaacagaagacaugcugucaguguggaauaggguuuggauagaggaaaacccauggauggaggacaaaacccauauauccaguuggggagauguuccauauuuaggaaaaagggaagaucaaugguguggaucccugauaggcuuaacagcaagggccaccugggccaccaacauacagguggccauaaaccaagugagaagacuaauugggaaugagaauuaucuagauuacaugacaucaaugaagagauucaagaacgagagugauccugaaggggcacucugguga

SEQ ID NO: 5876 - RNA, 9879 nt, Artificial Sequence
  derived and/or modified CDS sequence (wt) from DENV-1__GQ199802__SS-prME
ucugugaccaugcuccuuaugcugaugccuacagccuuggcguuccauuugacuacacgagggggagagccgcacaugauagucagcaagcaggaaagaggaaagucacucuuguuuaagaccucagcaggugucaacaugugcacccuuauagcgauggauuugggagaguugugugaggacacaaugacuuacaaaugcccucgaaucacugaaacugaaccagaugacguugauuguugguguaaugccacagacacaugggugaccuauggaacauguucccaaacuggcgagcaccgacgagacaaacguuccgucgcacuggccccacacgugggacuugguuuggaaacaagaaccgaaacguggauguccucugaaggcgcuuggaaacagauacaaagaguggagacuugggcccugagacacccaggauucacggugauagcccuuuuucuagcacaugccauaggaacauccaucacccagaaagggauuauuuucauuuuguuaaugcugguaacaccauccauggccaugcgaugcgugggaauaggcagcagggacuucguggaaggacugucaggagcaacuuggguagaugugguacuggaacauggaaguugcgucaccaccauggcaaaagacaaaccaacauuggacauugaacucuugaagacggaagucacaaacccugccguccugcgcaaacugugcauugaagcuaaaauaucaaacaccaccaccgacucaagauguccaacacaaggagaagccacacuaguggaagaacaagacgcgaacuuugugugucgacgaacguuuguggacagaggcuggggcaauggcugugggcucuucggaaaaggaagccuaauaacgugugcaaaguucaagugugugacaaaacuggaaggaaagauaguucaauaugagaacuugaaauauucaguaauagucaccguucacaccggagaccagcaccaagugggaaaugaaagcacagaacaugggacaacugcaacuauaacaccucaagcuccuacgacggaaauacagcugaccgacuacggagcucuuacauuggauuguucacccagaacaggacuagacuuuaaugaaaugguguuguugacaaugaaagaaaaaucauggcuaguccacaaacaaugguuuuuagaccuaccacugccuuggaccucgggagcuucaacaucacaagagacuuggaacagacaagauuugcuggugacauuuaagacagcucaugcaaagaagcaggaaguagucguacuaggaucacaagaaggagcaaugcacacugcguugaccggagcgacagaaauccaaacgucuggaacgacaacaauuuuugcaggacacuugaaaugcagacuaaagauggacaaacugacucuaaaagggaugucauaugugaugugcacaggcucauucaagcuagagaaagaaguggcugagacccagcauggaaccguucuagugcagauuaaauacgaaggaacagaugcaccaugcaagaucccuuuuucgacccaagaugaaaaaggaguaacccagaaugggagauugauaacagcuaaccccauaguuacugacaaagaaaaaccagucaacauugaggcagaaccgcccuuuggugagaguuacaucguaauaggagcaggugaaaaagcuuugaaacuaagcugguucaagaaaggaagcagcauagggaaaauguuugaggcaacugccagaggagcacgaaggauggccauacugggagacaccgcaugggacuuugguucuauaggaggaguguucacgucuguuggaaaauuaguacaccagauuuuuggaacugcauauggaguuuuguucagcgguguuuccuggaccaugaaaauaggaauagggguucugcugacauggcugggauuaaacucaaggagcacgucccuuucgaugacgugcauugcaguuggccuaguaacacuauaccuaggagucaugguucaggcggauucaggauguguaauuaauuggaaagguagagaacucaaguguggaaguggcauuuuugucaccaaugaaguucacacuuggacagagcaauacaaauuucaagcugacuccccuaagagacuaucagcagccaucgggaaggcaugggaggaggguguguguggaauucgaucagcaacucgucucgagaacaucauguggaagcaaauaucaaaugaacugaaucacaucuuacuugaaaaugauaugaaauucacagugguuguaggagauguugcugggaucuuggcucaaggaaagaaaaugauuaggccacaacccauggaauacaaauacucguggaaaagcuggggaaaggcuaaaaucauaggggcagauguacagaacaccaccuucaucaucgauggcccaaacaccccagaaugcccugaugaccaaagagcauggaacauuugggaaguugaggacuauggauuuggaauuuucacgacaaacauauggcugaaauugcgugauuccuacacccaagugugugaccaccggcuaaugucagcugccaucaaggacagcaaggcaguucacgcugacaugggguacuggauagaaagugaaaagaacgagaccuggaagcuggcaagagccucauucauagaaguuaaaacauguaucuggccaaaaucccacacucuauggagcaauggaguucuggaaagugaaaugauaauuccaaagaucuauggaggaccaauaucucagcacaacuacagaccaggauauuuuacacaagcagcagggccguggcaccuaggcaaguuggaacuggauuuugauuugugugaggguaccacaguuguuguggaugaacauuguggaaaucgaggaccaucucuuaggaccacaacagucacaggaaagauaauucaugaaugguguugcagaucuugcacgcuaccacccuuacguuucaaaggagaagaugggugcugguacgguauggaaaucagaccagucaaggaaaaggaagaaaaucuagucaaaucaauggucucugcagggucaggggaaguggacagcuuuucacuaggacugcuaugcauaucaauaaugaucgaggaggugaugagauccagauggaguagaagaaugcugaugacuggaacacuggcuguguucuuccuucucauaaugggacaauugacauggaacgaucugaucagauuaugcaucaugguuggagccaacgcuuccgacaggauggggaugggaacgacguaccuagcccugauggccacuuuuaaaaugagaccgauguucgcuguagggcuauuauuucgcagacuaacauccagagaaguucuucuucuaacaauuggauugagucuaguggcaucuguggaguuaccaaauuccuuggaggagcugggggauggacuugcaaugggcauuaugauuuuaaaauuauugacugacuuucaaucacaucagcugugggcuaccuugcuguccuugacauuuaucaaaacaacguuuuccuugcacuacgcauggaagacaauggcuaugguacugucaauuguaucucucuucccuuuaugccuguccacgaccucccaaaaaacaacauggcuuccggugcuauugggaucccuuggaugcaaaccacuaaccauguuucuuauagcagaaaacaaaaucuggggaaggagaaguuggccccucaaugaaggaaucauggcuguuggaauagucagcauccuacuaaguucacuccucaaaaaugauguaccgcuagcugggccacuaauagcuggaggcaugcuaauagcauguuauguuauaucuggaagcucagccgaccuaucauuagagaaagcggcugaggucuccugggaagaagaagcagaacacucuggugccucacacaacauauuaguggaaguccaagaugauggaaccaugaagauaaaggaugaagagagagaugacacgcuaaccauucuccuuaaagcaacucuguuagcaguuucagggguguacccauuaucaauaccagcgacccuuuucgugugguacuuuuggcagaaaaagaaacagagaucuggaguguuaugggacacacccagcccuccagaaguggaaagagcaguucuugaugaugguaucuauagaauuaugcagagaggacuguugggcaggucccaaguagggguaggaguuuuccaagaaaacguguuccacacaauguggcaugucaccaggggagcuguacucauguaucaagggaagagauuggaaccgagcugggccagugucaaaaaagaccugaucucauauggaggagguuggaggcuucaaggauccuggaacacaggagaagaagugcaggugauugcuguugaaccagggaaaaaccccaaaaauguacaaacagcgccgggcaccuuuaagaccccugaaggugaaguuggagccauugcccuagacuuuaaaccuggcacaucuggaucucccaucgugaacagagaaggaaaaauaguaggucuuuauggaaauggaguagugacaacaaguggaaccuacgucagugccauagcucaagccaaagcaucacaagaagggccccuaccagagauugaagacgagguguuuaggaaaagaaacuuaacaauaauggaccuacauccaggaucggggaaaacaagaagauaucuuccagccauaguccgugaggccauaaaaaggaagcugcgcacacuaauccuggcucccacaaggguugucgcuuccgaaauggcagaggcgcucaagggaaugccaauaagguaccaaacaacagcagugaagagugaacauacaggaaaagagauaguugaccucaugugucacgccacuuucaccaugcgccuccugucucccguaagaguucccaauuacaacaugaucaucauggaugaagcacauuucaccgauccauccaguauagcggccagaggguacaucucaacccgagugggcaugggugaagcagcugcaaucuucaugacagccacucccccaggaucaguggaggccuuuccacagagcaacgcaguuauccaagaugaggaaagagacauuccugagagaucauggaacucaggcuaugaguggaucacugacuucccagguaaaacaguuugguuuguuccaagcauuaaaucaggaaaugacauugccaacugcuuaagaaagaaugggaaacgggugauucaauugagcaggaaaaccuuugauacagaguaccaaaaaacaaaaaacaacgacugggacuacgucgucacaacagacaucuccgaaaugggagcaaauuuccgagccgacagggugauagacccaagacggugucugaaaccgguaauacuaaaagaugguccagagcgugucauuuuagcaggaccaaugccagugacuguggccagugcugcucagaggagaggaagaauuggaaggaaccacaauaaggaaggugaucaguacaucuacaugggacagccuuuaaacaacgaugaagaucacgcucacuggacagaagcaaaaaugcuccuugauaauauaaacacaccagaagggauuaucccagcccucuucgagccagagagagaaaagagugcagcaauagacggggaauacagacugcggggugaagcaaggaaaacguuuguggagcucaugagaagaggagaucuaccugucuggcuauccuacaaaguugccucagaaggcuuccaguacucugacagaagauggugcuuugacggggaaaggaacaaccagguguuggaggagaacauggacguggagaucuggacaaaagaaggagaaagaaagaaacuacgaccccgcuggcuggaugccagaacauacucagacccacuagcccugcgcgaguuuaaagaguuugcagcagggagaagaagcgucucaggugauuuaauauuagaaauagggaagcuuccacaacacuugacgcaaagggcccagaaugccuuggacaaccugguuauguugcacaacuccgaacaaggaggaagagccuauagacaugcaauggaagaacugccagacaccauagaaacguugaugcuccuagcuuugauagcuguguuaacugguggagugacacuguucuuccuaucaggaaggggccuagggaaaacaucuauuggccuacucugcguaauggcuucaagcguacugcuauggauggccaguguggagccccauuggauagcggccuccaucauacuggaguucuuccugauggugcugcuuauuccagagccagacagacaacgcacuccgcaggacaaccagcuggcauauguggugauagguuuguuauucaugauacugacaguagcagccaaugagaugggacugcuggaaaccacaaagaaagacuuagggauuggccauguggcuguugaaaaucaccaccaugccgcaaugcuggacguagacuuacauccagcuucagccuggacccucuaugcaguggccacaacaauuaucacucccaugaugaggcacacaaucgaaaacacaacggcaaacauuucccugacagccauugcaaaccaggcagcuauauugaugggacuugacaaaggauggccaauaucgaagauggacauaggaguuccacuucucgccuuggggugcuauucccaggugaauccacugacgcugacagcggcgguauugaugcuaguggcucauuacgccauaauuggaccuggacugcaagcaaaagcuacuagagaagcucaaaaaaggacagcggccggaauaaugaaaaauccaaccguugauggaauuguugcaauagauuuggacccugugguuuaugaugcaaaauuugaaaaacaacuaggccaaauaauguuguugauacuaugcacaucacagauccucuugaugcggacuacaugggccuugugcgaguccaucacacuggccacuggaccucugaccacgcuuugggagggaucuccaggaaaauuuuggaacaccacgauagcgguuuccauggcaaacauuuucagaggaaguuaucuagcaggagcaggucuggccuucucauuaaugaaaucucuaggaggagguaggagaggcacgggagcccaaggggaaacacugggagagaaauggaaaagacagcugaaccaacugagcaagucagaauuuaacaccuauaaaaggagugggauuauggaaguggacagauccgaagccaaagagggauugaaaagaggagaaacaaccaaacaugcagugucgagaggaaccgcuaaacugaggugguucguggagaggaaccuugugaaaccagaagggaaagucauagaccucgguuguggaagagguggcuggucauacuauugcgcugggcugaagaaagucacagaagugaagggguauacaaaaggaggaccuggacaugaggaaccaaucccaauggcgaccuauggauggaaccuaguaaagcugcacucugggaaagacguauuuuuuauaccaccugagaaaugugacacccuuuugugugauauuggugaguccucuccaaacccaacuauagaggaaggaagaacgcuacgcguccuaaagaugguggaaccauggcucagaggaaaccaauuuugcauaaaaauucugaaucccuacaugccaagugugguggaaacucuggagcaaaugcaaagaaaacauggaggaaugcuagugcgaaauccacuuucaagaaauucuacucaugaaauguauuggguuucauguggaacaggaaacauugugucagcaguaaacaugacaucuagaauguugcuaaaucgauucacaauggcucacaggaaaccaacauaugaaagagacguggaccuaggcgccggaacaagacauguggcaguggaaccagagguagccaaccuagauaucauuggccagaggauagagaacauaaaacaugaacauaagucaacauggcauuaugaugaggacaauccauauaaaacaugggccuaucauggaucauaugaggucaagccaucaggaucagccucauccauggucaauggcguggugaaacugcucaccaaaccaugggaugucaucccuauggucacacaaauagccaugacugacacuacacccuuuggacaacagaggguguuuaaagagaaaguugacacacgcacaccaaaagcaaaacggggcacagcacaaaucauggaggugacagccaagugguuauggguuuuucuuucuagaaacaagaaaccaagaauuugcacaagagaggaguucacaagaaaaguuaggucaaacgcagccauuggagcaguguucguugaugaaaaucaauggaacucagcaaaagaagcaguggaagaugagcgguucugggaccuugugcauagagagagggagcuucacaaacagggaaaaugugcuacguguguuuacaacaugauggggaagagagagaaaaagcuaggagaguucggaaaggcaaaaggaagucgugcaauaugguacaugugguugggagcacgcuuucuagaguucgaagcucuugguuucaugaacgaagaucacugguucagcagagagaauucacucagcggaguggaaggagaaggacuccacaaacuuggauauauacucagagacauaucaaagauuccagggggaaacauguaugcagaugacacagccggaugggauacaaggauaacagaggaugaccuucagaaugaggccagaauuacugacaucauggaacccgaacaugcccuacuggcuaagucaaucuucaaguuaaccuaccaaaauaaggugguaaggguacagagaccagcaaaaaauggaaccgugauggaugucauauccagacgugaccagagaggaaguggucaggucggaacuuauggcuuaaacacuuucaccaacauggaagcccagcugauaagacaaauggagucugagggaaucuuuucacccagcgaauuagagaccccaaauuuagccgagagaguucucgacuggcuggaaaaauauggcgucgaaaggcugaaaagaauggcaaucagcggagaugacugcguagugaaaccaauugaugauagguuugcaacagccuugacagcucugaaugauaugggaaaaguaagaaaagauauaccacaaugggaaccuucaaaaggauggaaugauuggcaacaagugccuuuuuguucacaccacuuccaccagcugauuaugaaggaugggagggaaauaguggugccaugccgcaaccaagaugaacuuguggguagggcuagaguaucacaaggugcuggauggagccugagagaaacugcaugccuaggcaagucauaugcacaaauguggcagcugauguacuuccacaggagagaccugagacuagccgcuaaugcuaucuguucagccguuccaguugauuggaucccaaccagccguaccaccuggucgauccaugcccaucaccaauggaugacaacagaagacaugcugucaguguggaauaggguuuggauagaggaaaacccauggauggaggacaaaacccacauauccaguuggggagauguuccauauuuaggaaaaagggaagaccaaugguguggaucccugauaggcuuaacagcaagggccaccugggccaccaacauacaaguggccauaaaccaagugagaagacuaauugggaaugagaauuaucuagauuacaugacaucaaugaagagauucaagaacgagagugaucccgaaggggcacucugguga
